(12) United States Patent
Hu et al.

(10) Patent No.: US 9,284,378 B2
(45) Date of Patent: Mar. 15, 2016

(54) HUMAN ANTIGEN BINDING PROTEINS THAT BIND β-KLOTHO, FGF RECEPTORS AND COMPLEXES THEREOF

(76) Inventors: Shaw-Fen Sylvia Hu, Thousand Oaks, CA (US); Ian Foltz, Burnaby (CA); Chadwick Terence King, N. Vancouver (CA); Yang Li, Mountain View, CA (US); Taruna Arora, Thousand Oaks, CA (US)

( * ) Notice: Subject to any disclaimer, the term of this patent is extended or adjusted under 35 U.S.C. 154(b) by 199 days.

(21) Appl. No.: 12/960,407

(22) Filed: Dec. 3, 2010

(65) Prior Publication Data

US 2011/0135657 A1 Jun. 9, 2011

Related U.S. Application Data

(60) Provisional application No. 61/267,321, filed on Dec. 7, 2009, provisional application No. 61/381,846, filed on Sep. 10, 2010.

(51) Int. Cl.
| | |
|---|---|
| *C07K 16/28* | (2006.01) |
| *C07K 16/40* | (2006.01) |
| *C07K 14/71* | (2006.01) |
| *C07K 16/18* | (2006.01) |
| *A61K 39/00* | (2006.01) |

(52) U.S. Cl.
CPC ............ *C07K 16/2863* (2013.01); *C07K 14/71* (2013.01); *C07K 16/18* (2013.01); *A61K 2039/505* (2013.01); *C07K 16/28* (2013.01); *C07K 16/40* (2013.01); *C07K 2317/21* (2013.01); *C07K 2317/56* (2013.01); *C07K 2317/565* (2013.01); *C07K 2317/75* (2013.01); *C07K 2319/30* (2013.01)

(58) Field of Classification Search
CPC ... C07K 16/28; C07K 16/40; A61K 2039/505
USPC .......... 530/350, 387.1, 387.3, 388.22, 388.26
See application file for complete search history.

(56) References Cited

U.S. PATENT DOCUMENTS

| | | | |
|---|---|---|---|
| 3,773,919 A | 11/1973 | Boswell et al. | |
| 4,179,337 A | 12/1979 | Davis et al. | |
| 4,301,144 A | 11/1981 | Iwashita et al. | |
| 4,376,110 A | 3/1983 | David et al. | |
| 4,496,689 A | 1/1985 | Mitra | |
| 4,640,835 A | 2/1987 | Shimizu et al. | |
| 4,670,417 A | 6/1987 | Iwasaki et al. | |
| 4,791,192 A | 12/1988 | Nakagawa et al. | |
| 4,816,567 A | 3/1989 | Cabilly et al. | |
| 4,892,538 A | 1/1990 | Aebischer et al. | |
| 4,945,050 A | 7/1990 | Sanford et al. | |
| 4,970,154 A | 11/1990 | Chang | |
| 5,011,472 A | 4/1991 | Aebischer et al. | |
| 5,106,627 A | 4/1992 | Aebischer et al. | |
| 5,217,889 A | 6/1993 | Roninson et al. | |
| 5,229,501 A | 7/1993 | Keifer et al. | |
| 5,234,784 A | 8/1993 | Aslam et al. | |
| 5,252,714 A | 10/1993 | Harris et al. | |
| 5,272,071 A | 12/1993 | Chappel | |
| 5,288,855 A | 2/1994 | Bergonzoni et al. | |
| 5,364,791 A | 11/1994 | Vegeto et al. | |
| 5,489,743 A | 2/1996 | Robinson et al. | |
| 5,545,807 A | 8/1996 | Surani et al. | |
| 5,557,032 A | 9/1996 | Mak | |
| 5,585,089 A | 12/1996 | Queen et al. | |
| 5,589,362 A | 12/1996 | Bujard et al. | |
| 5,593,875 A | 1/1997 | Wurm et al. | |
| 5,635,399 A | 6/1997 | Kriegler et al. | |
| 5,650,298 A | 7/1997 | Bujard et al. | |
| 5,654,168 A | 8/1997 | Bujard et al. | |

(Continued)

FOREIGN PATENT DOCUMENTS

| | | |
|---|---|---|
| CA | 2682096 A1 | 1/2009 |
| EP | 36676 A1 | 9/1981 |

(Continued)

OTHER PUBLICATIONS

Ogawa et al. (Proc. Natl. Acad. Sci. USA. May 1, 2007; 104 (18): 7432-7).*
Wong et al. (Gastroenterology. Jun. 2011; 140 (7): 1934-42).*
George et al. (Circulation. 1998; 97: 900-906).*
Rudikoff et al (Proc. Natl. Acad. Sci. USA. 1982; 79: 1979-1983).*
Mariuzza et al. (Annu. Rev. Biophys. Biophys. Chem. 1987; 16: 139-159).*
Gussow et al. (Methods in Enzymology. 1991; 203: 99-121).*
Giusti et al. (Proc. Natl. Acad. Sci. USA. May 1987; 84 (9): 2926-2930).*
Winkler et al. (J. Immunol. Oct. 15, 2000; 165 (8): 4505-4514).*
Chien et al. (Proc. Natl. Acad. Sci. USA. Jul. 1989; 86 (14): 5532-5536).*

(Continued)

*Primary Examiner* — Stephen Rawlings

(57) ABSTRACT

The present invention provides compositions and methods relating to or derived from antigen binding proteins activate FGF21-mediated signaling. In embodiments, the antigen binding proteins specifically bind to (i) β-Klotho; (ii) FGFR1c, FGFR2c, FGFR3c or FGFR4; or (iii) a complex comprising β-Klotho and one of FGFR1c, FGFR2c, FGFR3c, and FGFR4. In some embodiments the antigen binding proteins induce FGF21-like signaling. In some embodiments, an antigen binding protein is a fully human, humanized, or chimeric antibodies, binding fragments and derivatives of such antibodies, and polypeptides that specifically bind to (i) β-Klotho; (ii) FGFR1c, FGFR2c, FGFR3c or FGFR4; or (iii) a complex comprising β-Klotho and one of FGFR1c, FGFR2c, FGFR3c, and FGFR4. Other embodiments provide nucleic acids encoding such antigen binding proteins, and fragments and derivatives thereof, and polypeptides, cells comprising such polynucleotides, methods of making such antigen binding proteins, and fragments and derivatives thereof, and polypeptides, and methods of using such antigen binding proteins, fragments and derivatives thereof, and polypeptides, including methods of treating or diagnosing subjects suffering from type 2 diabetes, obesity, NASH, metabolic syndrome and related disorders or conditions.

3 Claims, 56 Drawing Sheets

(56) References Cited

U.S. PATENT DOCUMENTS

| | | |
|---|---|---|
| 5,672,510 A | 9/1997 | Eglitis et al. |
| 5,676,954 A | 10/1997 | Brigham |
| 5,679,559 A | 10/1997 | Kim et al. |
| 5,693,762 A | 12/1997 | Queen et al. |
| 5,707,632 A | 1/1998 | Williams et al. |
| 5,811,234 A | 9/1998 | Roninson et al. |
| 6,133,426 A | 10/2000 | Gonzalez et al. |
| 6,150,098 A | 11/2000 | Zhang |
| 6,214,795 B1 | 4/2001 | Benjamin et al. |
| 6,255,454 B1 | 7/2001 | Keifer et al. |
| 6,344,546 B1 | 2/2002 | Dionne et al. |
| 6,350,593 B1 | 2/2002 | Williams et al. |
| 6,355,440 B1 | 3/2002 | Williams et al. |
| 6,384,191 B1 | 5/2002 | Williams et al. |
| 6,548,634 B1 | 4/2003 | Ballinger et al. |
| 6,579,850 B1 | 6/2003 | Nabeshima et al. |
| 6,639,063 B1 | 10/2003 | Edwards |
| 6,656,728 B1 | 12/2003 | Kavanaugh et al. |
| 6,716,626 B1 | 4/2004 | Itoh |
| 6,844,168 B1 | 1/2005 | Keifer et al. |
| 7,259,248 B2 | 8/2007 | Itoh |
| 7,381,804 B2 | 6/2008 | Osslund |
| 7,408,047 B1 | 8/2008 | Thomason |
| 7,459,540 B1 | 12/2008 | Thomason et al. |
| 7,491,697 B2 | 2/2009 | Beals |
| 7,498,416 B2 | 3/2009 | Yayon et al. |
| 7,531,304 B2 | 5/2009 | Bange et al. |
| 7,645,857 B2 | 1/2010 | Zhou et al. |
| 7,667,005 B2 | 2/2010 | Nabeshima et al. |
| 7,678,890 B2 | 3/2010 | Bosch et al. |
| 7,695,938 B2 | 4/2010 | Thomason et al. |
| 7,696,153 B2 | 4/2010 | Nissen et al. |
| 7,696,172 B2 | 4/2010 | Thomason et al. |
| 7,700,558 B2 | 4/2010 | Thomason et al. |
| 7,704,952 B2 | 4/2010 | Thomason et al. |
| 7,727,742 B2 | 6/2010 | Thomason et al. |
| 7,879,323 B2 | 2/2011 | Thomason et al. |
| 7,887,799 B2 | 2/2011 | Thomason et al. |
| 8,372,952 B2 * | 2/2013 | Smith et al. ................ 530/350 |
| 2001/0012628 A1 | 8/2001 | Agarwal et al. |
| 2002/0081663 A1 | 6/2002 | Conklin |
| 2002/0164713 A1 | 11/2002 | Itoh |
| 2003/0220246 A1 | 11/2003 | Conklin |
| 2004/0018499 A1 | 1/2004 | Lal |
| 2004/0063910 A1 | 4/2004 | Kavanaugh et al. |
| 2004/0185494 A1 | 9/2004 | Itoh |
| 2004/0259780 A1 | 12/2004 | Glasebrook |
| 2005/0037457 A1 | 2/2005 | Itoh |
| 2005/0176631 A1 | 8/2005 | Heuer |
| 2005/0187150 A1 | 8/2005 | Mohammadi et al. |
| 2006/0223114 A1 | 10/2006 | Stemmer |
| 2007/0036806 A1 | 2/2007 | Glaesner |
| 2007/0128619 A1 | 6/2007 | Ito |
| 2007/0142278 A1 | 6/2007 | Beals |
| 2007/0237768 A1 | 10/2007 | Glaesner |
| 2007/0238657 A1 | 10/2007 | Itoh |
| 2007/0265200 A1 | 11/2007 | Glaesner |
| 2007/0293430 A1 | 12/2007 | Frye |
| 2007/0299007 A1 | 12/2007 | Frye |
| 2008/0071065 A1 | 3/2008 | Thomason |
| 2008/0071066 A1 | 3/2008 | Thomason |
| 2008/0103096 A1 | 5/2008 | Frye |
| 2008/0124344 A1 | 5/2008 | Combs et al. |
| 2008/0242607 A1 | 10/2008 | DeFrees |
| 2008/0248959 A1 | 10/2008 | DeFrees |
| 2008/0253992 A1 | 10/2008 | DeFrees et al. |
| 2008/0255040 A1 | 10/2008 | DeFrees |
| 2008/0255045 A1 | 10/2008 | Cujec |
| 2008/0261236 A1 | 10/2008 | Kuro-o |
| 2008/0261875 A1 | 10/2008 | Etgen |
| 2008/0274958 A1 | 11/2008 | DeFrees |
| 2009/0074776 A1 | 3/2009 | Itoh |
| 2009/0098131 A1 | 4/2009 | Clark et al. |
| 2009/0118190 A1 | 5/2009 | Beals et al. |
| 2009/0123462 A1 | 5/2009 | Bange |
| 2009/0192087 A1 | 7/2009 | Glass et al. |
| 2009/0202554 A1 | 8/2009 | Berezin et al. |
| 2009/0305986 A1 | 12/2009 | Belouski et al. |
| 2010/0047251 A1 | 2/2010 | Yayon et al. |
| 2010/0087627 A1 | 4/2010 | Marshall et al. |
| 2010/0158911 A1 | 6/2010 | Williams et al. |
| 2010/0158914 A1 | 6/2010 | Desnoyers |
| 2010/0184665 A1 | 7/2010 | Suzuki et al. |
| 2010/0226921 A1 | 9/2010 | Thomason et al. |
| 2010/0233169 A1 | 9/2010 | Thomason et al. |
| 2010/0285131 A1 | 11/2010 | Belouski |
| 2010/0310566 A1 | 12/2010 | Thomason et al. |
| 2011/0003302 A1 | 1/2011 | Thomason et al. |

FOREIGN PATENT DOCUMENTS

| | | |
|---|---|---|
| EP | 58481 A1 | 8/1982 |
| EP | 88046 A2 | 9/1983 |
| EP | 0133988 A2 | 3/1985 |
| EP | 143949 A1 | 6/1985 |
| EP | 154316 A2 | 9/1985 |
| EP | 401384 A1 | 12/1990 |
| EP | 505500 A1 | 9/1992 |
| EP | 0545343 A1 | 6/1993 |
| EP | 315456 B1 | 6/1994 |
| EP | 546073 B1 | 9/1997 |
| EP | 2060270 A2 | 10/2004 |
| EP | 1697420 A2 | 7/2005 |
| EP | 2163626 A1 | 3/2010 |
| WO | 90/04036 | 4/1990 |
| WO | 91/09955 | 7/1991 |
| WO | 91/10425 | 7/1991 |
| WO | 91/10470 | 7/1991 |
| WO | 91/10741 | 7/1991 |
| WO | 93/15722 | 8/1993 |
| WO | 94/02602 | 2/1994 |
| WO | 94/20069 | 9/1994 |
| WO | 94/28122 | 12/1994 |
| WO | 95/05452 | 2/1995 |
| WO | 95/34670 | 12/1995 |
| WO | 96/11953 | 4/1996 |
| WO | 96/32478 | 10/1996 |
| WO | 96/33735 | 10/1996 |
| WO | 96/37609 | 11/1996 |
| WO | 96/40958 | 12/1996 |
| WO | 96/41865 | 12/1996 |
| WO | 97/31899 | 9/1997 |
| WO | 97/34631 | 9/1997 |
| WO | 99/10494 | 3/1999 |
| WO | 99/27100 | 6/1999 |
| WO | 00/18921 A2 | 4/2000 |
| WO | 00/24782 | 5/2000 |
| WO | 00/27885 A1 | 5/2000 |
| WO | 00/54813 | 9/2000 |
| WO | 01/18172 | 3/2001 |
| WO | 01/18209 | 3/2001 |
| WO | 01/32678 | 5/2001 |
| WO | 01/36640 | 5/2001 |
| WO | 01/38357 | 5/2001 |
| WO | 01/49849 | 7/2001 |
| WO | 01/72957 | 10/2001 |
| WO | 02/36732 | 5/2002 |
| WO | 03/011213 | 2/2003 |
| WO | 03/059270 | 7/2003 |
| WO | 2004/022095 A1 | 3/2004 |
| WO | 2004/044011 A2 | 5/2004 |
| WO | 2004/083381 A2 | 9/2004 |
| WO | 2004/100976 A1 | 11/2004 |
| WO | 2004/110472 | 12/2004 |
| WO | 2005/037235 A2 | 4/2005 |
| WO | 2005/061712 | 7/2005 |
| WO | 2005/072769 | 8/2005 |
| WO | 2005/091944 | 10/2005 |
| WO | 2005/113606 | 12/2005 |
| WO | 2006/028595 | 3/2006 |
| WO | 2006/028714 | 3/2006 |
| WO | 2006/050247 | 5/2006 |
| WO | 2006/065582 | 6/2006 |
| WO | 2006/078463 | 7/2006 |

(56) References Cited

FOREIGN PATENT DOCUMENTS

| | | |
|---|---|---|
| WO | 2006/095559 A1 | 9/2006 |
| WO | 2006/130527 A2 | 12/2006 |
| WO | 2007/055789 | 5/2007 |
| WO | 2007/100695 | 9/2007 |
| WO | 2008/011633 | 1/2008 |
| WO | 2008/121563 | 10/2008 |
| WO | 2008/123625 A1 | 10/2008 |
| WO | 2008/149521 A1 | 11/2008 |
| WO | 2008/151258 | 12/2008 |
| WO | 2008/153705 | 12/2008 |
| WO | 2009/009173 A1 | 1/2009 |
| WO | 2009/020802 | 2/2009 |
| WO | 2009/149171 | 12/2009 |
| WO | 2010/006214 A1 | 1/2010 |
| WO | 2010/129503 | 11/2010 |
| WO | 2011/071783 A1 | 6/2011 |

OTHER PUBLICATIONS

Caldas et al. (Mol. Immunol. May 2003; 39 (15): 941-952).*
Vajdos et al. (J. Mol. Biol. Jul. 5, 2002; 320 (2): 415-428).*
De Pascalis et al. (J. Immunol. 2002; 169 (6): 3076-3084).*
Wu et al. (J. Mol. Biol. Nov. 19, 1999; 294 (1): 151-162).*
Casset et al. (Biochem. Biophys. Res. Commun. Jul. 18, 2003; 307 (1): 198-205).*
MacCallum et al. (J. Mol. Biol. Oct. 11, 1996; 262 (5): 732-745).*
Holm et al. (Mol. Immunol. Feb. 2007; 44 (6): 1075-1084).*
Hu et al., (1998), "FGF-18, a novel member of the fibroblast growth factor family, stimulates hepatic and intestinal proliferation," Mol. Cell. Biol. 18(10): 6063-6074.
Hull et al (1997), "Healing with basic fibroblast growth factor is associated with reduced indomethacin induced relapse in a human model of gastric ulceration," Gut 40: 204-10.
Inagaki, T. et al. (2005) "Fibroblast growth factor 15 functions as an enterohepatic signal to regulate bile acid homeostasis," Cell. Metab. 2:217-225.
Ishibashi et al., 2005, "Is arginine a protein-denaturant?" Protein Expr. Purif. 42: 1-6.
Itoh and Ornitz (2004), "Evolution of the FGF and FGFR gene families," Trends in Genetics 20(11): 563-569.
Jakobovits et al., 1993, "Analysis of homozygous mutan chimeric mice: deletion of the immunoglobulin heavy-chain joining region blocks B-cell development and antibody production" Proc. Natl. Acad. Sci. U.S.A. 90:2551-55.
Jakobovits et al., 1993, "Germ-line transmission and expression of a human-derived yeast artificial chromosome" Nature 362: 255-58.
Jones et al., 1986, "Replacing the complementarity-determining regions in a human antibody with those from a mouse" Nature 321: 522-25.
Kohler et al., "Continuous cultures of fused cells secreting antibody of predefined specificity," Nature 256: 495-97 (1975).
Kurosu, Hiroshi et al., "Tissue-specific Expression of Klotho and Fibroblast Growth Factor (FGF) Receptor Isoforms Determines Metabolic Activity of FGF19 and FGF21," J. Biol. Chem. 282:26687-26695 (2007).
Kurosu, Hiroshi & Kuro-o, Makoto, (2008) "The klotho gene family and the endocrine fibroblast growth factors," Curr. Opin. Nephrol. Hypertens. 17:368-372.
Kurosu, Hiroshi & Kuro-o, Makoto, "The Klotho gene family as a regulator of endocrine fibroblast growth factors," Mol. Cell. Endocrinol. 299:72-78 (2009).
Kaufman et al. (1999), "Transgenic analysis of a 100-kb human beta-globin cluster-containing DNA fragment propagated as a bacterial artificial chromosome." Blood 94: 3178-3184.
Kennell (1971), "Principles and practices of nucleic acid hybridization." Progr. Nucl. Acid Res. Mol. Biol. 11: 259-301.
Kharitonenkov et al. (2005), "FGF-21 as a novel metabolic regulator," J. Clin. Invest. 115: 1627-1635.
Kharitonenkov et al. (2006), "The metabolic state of diabetic monkeys is regulated by FGF-21" Endocrinology DOI:10.1210/en.2006-1168.
Kharitonenkov et al. (2007), "The metabolic state of diabetic monkeys is regulated by FGF-21" Endocrinology 148:774-781.
Kharitonenkov et al. (2008), "Fibroblast Growth Factor-21 as a Therapeutic Agent for Metabolic Diseases" Biodrugs 22 1: 37-44.
Kohler et al., 1975, "Continuous cultures of fused cells secreting antibody of predefined specificity" Nature 256: 495-97.
Kornmann et al. (1998), "Role of fibroblast growth factors and their receptors in pancreatic cancer and chronic pancreatitis," Pancreas 17: 169-75.
Kozbor, 1984, "A human hybrid myeloma for production of human monoclonal antibodies" J. Immunol. 133: 3001.
Laemmli, 1970, "Cleavage of structural proteins during the assembly of the head of bacteriophage T4" Nature 227: 680-85.
Langer et al., 1981, "Biocompatibility of polymeric delivery systems for macromolecules" J. Biomed. Mater. Res. 15: 267-277.
Langer et al., 1982, "Controlled release of macromolecules" Chem. Tech. 12: 98-105.
Ledley (1996), "Pharmaceutical Approach to Somatic Gene Therapy." Pharm. Res. 13(11): 1595-1614. (Examiner).
Lewis et al. (1997), "Angiogenesis by gene therapy: a new horizon for myocardial revascularization?" Cardiovasc. Res. 135: 490-497.
Lin, Benjamin C., et al., "Liver-specific Activities of FGF19 Require Klotho beta," J. Bio. Chem. 282. 27277-27284.
Liu et al. (2007), "FGF18 is required for early chondrocyte proliferation, hypertrophy and vascular invasion of the growth plate," Dev. Biol. 302: 80-91.
Mahairas et al. (1999), "Sequence-tagged connectors: a sequence approach to mapping and scanning the human genome," PNAS 96(17): 9739-9744.
Mannall et al., 2007, "Factors affecting protein refolding yields in a fed-batch and batch-refolding system" Biotechnol. Bioeng. 97: 1523-34.
Marks et al., 1991, "By-passing immunization. Human antibodies from V-gene libraries displayed on phage" J. Mol. Biol. 222: 581-597.
Mikkelsen (1993), "Interpreting sequence motifs: a cautionary note," Trends Genet. 9(5): 15.
Mohammadi, et al. (2005), "Structural basis for fibroblast growth factor receptor activation" Cytokine & Growth Factor Reviews 16: 107-137.
Morrison et al., 1985, "Chimeric human antibody molecules: mouse antigen-binding domains with human constant region domains" Proc. Natl. Acad. Sci. U.S.A. 81: 6851-55.
Moyers et al. (2007), "Molecular Determinants of FGF-21 Activity-Synergy and Cross-Talk with PPARγ Signaling" J. Cell. Phys. 210: 1-6.
Nakamura et al. (1995), "The murine lymphotoxin-beta receptor cDNA: isolation by the signal sequence trap and chromosomal mapping," Genomics 30(2): 312-19.
Ngo et al. (1994), "Computational complexity, protein structure prediction, and the Levinthal paradox," in The Protein Folding Problem and Tertiary Structure Prediction, Merz & Le Grand ed., Birkhauser: Boston, pp. 491-495.
Nicholes, Katrina et al., "A mouse model of hepatocellular carcinoma: ectopic expression of fibroblast growth factor 19 in skeletal muscle of transgenic mice," Am. J. Pathol. 160:2295-2307 (2002).
Nishimura et al. (2000), "Identification of a novel FGF, FGF-21, preferentially expressed in the liver(I)," Biochim Biophys Acta 21: 203-6.
Niyogi (1969), "The influence of chain length and base composition on the specific association of oligoribonucleotides with denatured deoxyribonucleic acid," J. Biol. Chem. 244(6): 1576-81.
Ogawa, Y., et al. (2005) "Klotho is required for metabolic activity of fibroblast growth factor 21," Proc. Natl. Acad. Sci. USA 104:7432-7437.
Parthiban et al. (2007), "Computational modeling of protein mutant stability: analysis and optimization of statistical potentials and structural features reveal insights into prediction model development," BMC Struct. Biol. 7:54.
Prathiban et al., 2006, "MSH2 is essential for the preservation of genome integrity and prevents homeologous recombination in the moss *Physcomitrella patens*" Nucleic Acids Res. 34: 232-42.

(56) References Cited

OTHER PUBLICATIONS

Peus and Pittelkow (1996), "Growth factors in hair organ development and the hair growth cycle," Dermatol. Clin. 14:559-72.
Phillips (2001), "The challenge of gene therapy and DNA delivery," J. Pharm. Pharmacology 53: 1169-1174.
Plotnikov et al. (1999), "Structural Basis for FGF Receptor Dimerization and Activation" Cell 98: 641-650.
Plotnikov et al. (2000), "Crystal Structures of Two FGF-FGFR Complexes Reveal the Determinants of Ligand-Receptor Specificity," Cell 101: 413-24.
Podolsky (1997), "Healing the epithelium: solving the problem from two sides" J. Gastroenterol. 32: 122-6.
Polejaeva et al. (2000), "New advances in somatic cell nuclear transfer: application in transgenesis," Theriogenology 53(1): 117-26.
Ratajczak (1997), "Fibroblast Growth factors and early hemopoietic cell development," Leuk. Lymphoma 27: 221-9.
Remington's Pharmaceutical Sciences (18th Ed., A.R. Gennaro, ed., Mack Publishing Company 1990).
Riechmann et al., 1998, "Reshaping human antibodies for therapy" Nature 332: 323-27.
Rudolph et al., 1997, "Folding proteins," Protein Function: A Practical Approach (Creighton, ed., New York, IRL Press) 57-99.
Rulicke et al. (2000), "Germ line transformation of mammals by pronuclear microinjection," Exp. Physiol. 85(6): 589-601.
Sambrook, et al. Molecular Cloning: A Laboratory Manual (Cold Spring Harbor Laboratory Press, 1989).
Schlessinger, J. et al., "Crystal Structure of a Ternary FGF-FGFR-Heparin Complex Reveals a Dual Role for Heparin in FGFR Binding and Dimerization," Mol. Cell 6:743-50 (2000).
Sidman et al., 1983, "Controlled release of macromolecules and pharmaceuticals from synthetic polypeptides based on glutamic acid" Biopolymers 22: 547-56.
Skolnick et al. (2000), "From genes to protein structure and function: novel applications of computational approaches in the genomic era," Trends Biotechnol. 18(1): 34-39.
Smallwood et al. (1996), "Fibroblast Growth Factor (FGF) homologous factors: new members of the FGF family implicated in nervous system development", PNAS 93: 9850-9857.
Smith et al. (1997), "The challenges of genome sequence annotation or 'the devil is in the details,'" Nat. Biotechnol. 15(12): 1222-23.
Tomlinson, E. et al. (2002) "Transgenic mice expressing human fibroblast growth factor-19 display increased metabolic rate and decreased adiposity," Endocriniology 143:17419-1747.
Trouiller, et al. (2006), "MSH2 is essential for the preservation of genome integrity and prevents homeologous recombination in the moss *Physcomitrella patens*" Nucleic Acids Research vol. 34, (1): 232-242.
Verhoeyen et al., 1988, "Reshaping human antibodies: grafting an antilysozyme activity" Science 239: 1534-36.
Verma et al. (1997), "Gene therapy—promises,problems and prospects," Nature 389: 239-242. (Examiner).
Wang et al. (1999), "Rapid analysis of gene expression (RAGE) facilitates universal expression profiling," Nuc. Acids Res. 27: 4609-4618.
Webster (1997), "Growth factors and myelin regeneration un multiple sclerosis," Mult. Scler. 3:113-20.
Wente et al. (2006), "Fibroblast Growth Factor-21 Improves Pancreatic B-Cell Function and Survival by Activation of Extracellular Signal-Regulated Kinase ½ and Akt Signaling Pathways" Diabetes 55: 2470-2478.
Wishcke & Schwendeman, 2008, "Principles of encapsulating hydrophobic drugs in PLA/PLGA microparticles" Int. J. Pharm. 364: 298-327.
Wu, Xinle et al. (2008) "C-terminal Tail of FGF19 Determines Its Specificity toward Klotho Co-receptors," J. Biol. Chem. 283(48):33304-9.
Xu et al., (2009) "Fibroblast Growth Factor 21 Reverses Hepatic Steatosis, Increases Energy Expenditure, and Improves Insulin Sensitivity in Diet-Induced Obese Mice" Diabetes 58(1):250-9.
Yamaoka and Itakura (1999), "Development of pancreatic islets (review)," Int. J. Mol. Med. 3: 247-61.
Yie et al., 2009, "FGF21 N- and C-terminal play different roles in receptor interaction and activation" FEBS Lett. 583:19-24.
Zola, Monoclonal Antibodies: A Manual of Techniques 147-158 (CRC Press, Inc., 1987).
[The] ADHR consortium (2000), "Autosomal dominant hypophosphataemic rickets is associated with mutations in FGF23," Nature Genetics 26: 345-348.
Arner et al. (2008) "FGF21 attenuates lipolysis in human adipocytes—A possible link to improved insulin sensitivity" FEBS Letters 582: 1725-1730.
Artuc et al. (1999), "Mast cells and their mediators in cutaneous wound healing—active participants or innocent bystanders?" Exp. Dermatol. 8: 1-16.
Ausubel, et al., Current Protocols in Molecular Biology (Ausubel et al., eds., Green Publishers Inc. and Wiley and Sons 1994).
Bayer et al., 1990, "Protein biotinylation" Meth. Enz. 184: 138-63.
Beck and Podolsky (1999), "Growth factors in inflammatory bowel disease." Inflamm. Bowel Dis. 5: 44-60.
Bishop (1996), "Chromosomal insertion of foreign DNA," Reprod. Nutr. Dev. 36(6): 607-18.
Bork (2000), "Powers and pitfalls in sequence analysis: the 70% hurdel," Genome Res. 10(4): 398-400.
Bork et al. (1996), "Go hunting in sequence databases but watch out for the traps," Trends Genet. 12(10): 425-27.
Branch (1998), "A good antisense molecule is hard to find," Trends Biochem Sci. 23(2): 45-50.
Brenner (1999), "Errors in genome annotation," Trends Genet. 15(4): 132-33.
Brodeur et al., Monoclonal Antibody Production Techniques and Applications 51-63 (Marcel Dekker, Inc., 1987).
Bruggermann et al., (1993), "Designer mice: the production of human antibody repertoires in transgenic animals" Year in Immuno. 7: 33.
Capon et al., (1989), "Designing CD4 immunoadhesins for AIDS therapy" Nature 337: 525-31.
Cunha et al. (1996), "Keratinocyte growth factor as mediator of mesenchymal-epithelial interactions in the development of androgen traget organs." Semin Cell Dev Biol 7: 203-210.
Dailey, et al. (2005), "Mechanisms underlying differential responses to FGF signaling," Cytokine & Growth Factor Reviews 16: 233-247.
Database UniProt Q9DDN0, Accession No. 09DNN0, "Fibroblast growth factor 19," XP002596987 (2001).
Database UniProt Q76B59, Accession No. Q76B59, "Fibroblast growth factor 19," XP002596988 (2004).
Database UniProt B7U4G3, Accession No. B7U4G3, "FGF19," XP002596989 (2009).
Database UniProt B3DHS4, Accession No. B3DHS4, "FGF19 protein," XP002596990 (2008).
Debernardez Clark E., (1998), "Refolding of recombinant proteins" Curr. Opin. Biotechnol. 9: 157-63.
Doerks et al. (1998), "Protein annotation: detective work for function prediction," Trends Genet. 14(6): 248-50.
Ebadi et al. (1997), "Neurotrophins and their receptors in nerve injury and repair," Neurochem. Int. 30: 347-74.
Econs and McEnery (1997) "Autosomal dominant hypophosphatemic rickets/osteomalacia: clinical characterization of a novel renal phosphate-wasting disorder," J Clin Endocrinol Metab 82:674-681.
Ellison et al., (1982), "The nucleotide sequence of a human immunoglobulin Cγl gene" Nucleic Acids Res. 10: 4071-9).
Eppstein, et al., (1985) "Biological activity of liposome-encapsulated murine interferon y is mediated by a cell membrane receptor" Proc. Natl. Acad. Sci. U.S.A. 82:3688-92.
Eswarakumar, et al. (2005) "Cellular signalling by fibroblast growth factor receptors" Cytokine & Growth Factor Reviews 16: 139-149.
Faham, S. et al., (1998) "Diversity does make a difference: fibroblast growth factor-heparin interactions," Curr. Opin. Struct. Biol. 8(5): 578-586.
Fausto, N., "Mouse liver tumorigenesis: models, mechanisms, and relevance to human disease," Seminars in Liver Disease 19:243-252 (1999).

(56) References Cited

OTHER PUBLICATIONS

Francis et al. (1992), "Protein modification and fusion proteins," Focus on Growth Factors 3:4-10.
Freiberg & Zhu, (2004) "Polymer microspheres for controlled drug release" Int. J. Pharm. 282:1-18.
Fu, Ling, et al. (2004) "Fibroblast growth factor 19 increases metabolic rate and reverses dietary and leptin-deficient diabetes," Endocroinology 145:2594-2603.
Fukumoto, Seji, and Yamashita, T. (2007) "FGF23 is a hormone-regulating phosphate metabolism—Unique Biological characteristics of FGF21," Bone 40:1190-1195.
Fukumoto, Seji, (2008) "Actions and mode of actons of FGF19 subfamily members," Endocr. J. 55:23-31.
Galzie Z. et al. (1997), "Fibroblast Growth Factors and their Receptors", Biochemistry and Cell Biology 75(6): 669-685.
GenBank Acc. No. AB006136, Aug. 27, 1997.
GenBank Acc. No. AQ175436, Sep. 21, 1998, accessed Nov. 18, 2005.
GenBank Acc. No. AV050323, Jun. 16, 1999, accessed Nov. 18, 2005.
GenBank Acc. No. BAA99415, Aug. 3, 2000.
GenBank Acc. No. BAA99416, Jul. 11, 2000.
GenBank Acc. No. NP_061986, Apr. 6, 2003.
GenBank Acc. No. Q9NSA1, Oct. 1, 2000.
Ghielli et al. (1998), "Regeneration processes in the kidney after acute injury: role of infiltrating cells," Exp. Nephrol. 6: 502-507.
Goetz et al., "BBA—Molecular and Cell Biology of Lipids," Mol. Cell. Biol. 27:3417-28 (2007).
Goldfarb (1996). "Functions of fibroblast growth factors in vertebrate development," Cytokine Growth Factor Rev. 7(4): 311-325.
Harmer, Nicholas J., et al., "The crystal srtucture of fibroblast growth factor (FGF) 19 reveals novel features of the FGF family and offers a structural basis for its unusual receptor affinity," Biochem 43(3): 629-640 (2004).
Ho, Han Kiat, et al., "Fibroblast growth factor receptor 4 regulates proliferation, anti-apoptosis and alpha-fetoprotein secretion during hepatocellular carcinoma progression and represents a potential target for therapeutic intervention," J. Hepatol. 50:118-127 (2009).
Hoogenboom et al., 1991, "By-passing immunisation, Human antibodies from synthetic repertoires of germline VH gene segments rearranged in vitro" J. Mol. Biol. 227: 381.
Hoppenreijs et al. (1996), "Corneal endothelium and growth factors," Surv. Opthalmol. 41: 155-64.
Hsu et al. (1999), "Heparin is Essential for a Single Keratinocyte Growth Factor Molecule to Bind and Form a Complex with Two Molecules of the Extracellular Domain of Its Receptor," Biochemistry 38: 2523-34.

Beenken, Andrew and Mohammadi, Moosa (2009), "The FGF family: biology, pathophysiology and therapy," Nature Reviews 8:235-253.
R&D Systesm, Catalog No. MAB3738, Lot No. XRU02 (2007), "Monoclonal anti-human/mouse Klotho Beta antibody," XP-002624719.
Suzuki, Masashi et al. (2008) "Beta-klotho is required for fibroblast growth factor (FGF) 21 signaling through FGF receptor (FGFR) 1c and FGFR3c," Mol. Endocr. 22(4):1006-1014.
R&D Systems, Catalog No. MAB3738, Lot No. XRU02 (2007), "Monoclonal anti-human/mouse Klotho Beta antibody," XP-0026424719.
Li, Xiaofan, et al. (2009) "Inhibition of lipolysis may contribute to the acute regulation of plasma FFA and glucose by FGF21 in ob/ob mice," FEBS Letters 583: 323-03234.
Wu, Xinle et al. (2008) "C-terminal tail of FGF19 determines its specificity toward klotho co-receptors," J. Biol. Chem. 283 (48): 33304-33309.
Wu, Xinle et al. (2007) "Co-receptor requirements for fibroblast growth factor-19 signaling," J. Biol. Chem. 282 (40): 29069-29072.
Wu, Xinle et al. (2009) "Selective activation of FGFR4 by an FGF19 variant does not improve glucose metabolism in ob/ob mice," PNAS 106 (34): 14379-14384.
Wu, Xinle et al. (2010) "Separating mitogenic and metabolic activities of fibroblast growth factor 19 (FGF19)," PNAS 107 (32): 14158-14163.
Xu, Jing et al. (2009) "Acute glucose-lowering and insulin-sensitizing action of FGF21 in insulin-resistant mouse models-association with liver and adipose tissue effects," Am. J. Physiol. Endocrinol. Metabl. 297: E1105-E1114.
Bork et al (1998), "Predicting functions from protein sequences—where are the bottlenecks?" Nature Genetics 18(4): 313-18.
Gupte, et al. (2011), "FGFR D3 Domain Determines Receptor Selectivity for Fibroblast Growth Factor 21," J. Mol. Biol. 408:491.
Wu et al. (2010), "FGF19 induced hepatocyte proliferation is mediated through FGFR4 activiation," J. Biol. Chem. 285:5165.
Ogawa et al. (2007), "Beta-klotho is required for metabolic activity of fibroblast growth factor 21," PNAS 104(18) 7432-7437.
Wu, X. and Li, Y. (2011) Understanding the structure-function relationship between FGF19 and its motogenic and metabolic activities. In Endocrine FGFs and Klothos, edited by Makoto Kuro-o, Landes Bioscience and Springer Science Media.
Wu, X., et al. (2009) "Role of FGF19 induced FGFR4 activation in the regulation of glucose homeostatis," Aging 1:1023.
Kurd-O, "Endocrine FGFs and Klothos: emerging concepts", Trends in Endocrinology and Metabolism, Elsevier Science Publishing, NY, NY, US, Sep. 1, 2008, 239-245,V.19, No. 7.

* cited by examiner

FIG.1A

```
                     1                                                50
hu  FGFR1    (1)   MWSWKCLLFWAVLVTATLCTARPSPTLPEQAQPWGAPVEVESFLVHPGDL
    muFGFR1  (1)   MWGWKCLLFWAVLVTATLCTARPAPTLPEQAQPWGVPVEVESLLVHPGDL
Consensus    (1)   MW WKCLLFWAVLVTATLCTARPAPTLPEQAQPWG PVEVES LVHPGDL
                     51                                               100
hu  FGFR1   (51)   LQLRCRLRDDVQSINWLRDGVQLAESNRTRITGEEVEVQDSVPADSGLYA
    muFGFR1 (51)   LQLRCRLRDDVQSINWLRDGVQLVESNRTRITGEEVEVRDSIPADSGLYA
Consensus   (51)   LQLRCRLRDDVQSINWLRDGVQL ESNRTRITGEEVEV DSIPADSGLYA
                    101                                               150
hu  FGFR1  (101)   CVTSSPSGSDTTYFSVNVSDALPSSEDDDDDDSSSEEKETDNTKPNRMP
    muFGFR1 (101)  CVTSSPSGSDTTYFSVNVSDALPSSEDDDDDDSSSEEKETDNTKPNRRP
Consensus  (101)   CVTSSPSGSDTTYFSVNVSDALPSSEDDDDDDSSSEEKETDNTKPNR P
                    151                                               200
hu  FGFR1  (151)   VAPYWTSPEKMEKKLHAVPAAKTVKFKCPSSGTPNPTLRWLKNGKEFKPD
    muFGFR1 (151)  VAPYWTSPEKMEKKLHAVPAAKTVKFKCPSSGTPNPTLRWLKNGKEFKPD
Consensus  (151)   VAPYWTSPEKMEKKLHAVPAAKTVKFKCPSSGTPNPTLRWLKNGKEFKPD
                    201                                               250
hu  FGFR1  (201)   HRIGGYKVRYATWSIIMDSVVPSDKGNYTCIVENEYGSINHTYQLDVVER
    muFGFR1 (201)  HRIGGYKVRYATWSIIMDSVVPSDKGNYTCIVENEYGSINHTYQLDVVER
Consensus  (201)   HRIGGYKVRYATWSIIMDSVVPSDKGNYTCIVENEYGSINHTYQLDVVER
                    251                                               300
hu  FGFR1  (251)   SPHRPILQAGLPANKTVALGSNVEFMCKVYSDPQPHIQWLKHIEVNGSKI
    muFGFR1 (251)  SPHRPILQAGLPANKTVALGSNVEFMCKVYSDPQPHIQWLKHIEVNGSKI
Consensus  (251)   SPHRPILQAGLPANKTVALGSNVEFMCKVYSDPQPHIQWLKHIEVNGSKI
                    301                                               350
hu  FGFR1  (301)   GPDNLPYVQILKTAGVNTTDKEMEVLHLRNVSFEDAGEYTCLAGNSIGLS
    muFGFR1 (301)  GPDNLPYVQILKTAGVNTTDKEMEVLHLRNVSFEDAGEYTCLAGNSIGLS
Consensus  (301)   GPDNLPYVQILKTAGVNTTDKEMEVLHLRNVSFEDAGEYTCLAGNSIGLS
                    351                                               400
hu  FGFR1  (351)   HHSAWLTVLEALEERPAVMTSPLYLEIIIYCTGAFLISCMVGSVIVYKMK
    muFGFR1 (351)  HHSAWLTVLEALEERPAVMTSPLYLEIIIYCTGAFLISCMLGSVITYKMK
Consensus  (351)   HHSAWLTVLEALEERPAVMTSPLYLEIIIYCTGAFLISCMLGSVIIYKMK
                    401                                               450
hu  FGFR1  (401)   SGTKKSDFHSQMAVHKLAKSIPLRRQVTVSADSSASMNSGVLLVRPSRLS
    muFGFR1 (401)  SGTKKSDFHSQMAVHKLAKSIPLRRQVTVSADSSASMNSGVLLVRPSRLS
Consensus  (401)   SGTKKSDFHSQMAVHKLAKSIPLRRQVTVSADSSASMNSGVLLVRPSRLS
                    451                                               500
hu  FGFR1  (451)   SSGTPMLAGVSEYELPEDPRWELPRDRLVLGKPLGEGCFGQVVLAEAIGL
    muFGFR1 (451)  SSGTPMLAGVSEYELPEDPRWELPRDRLVLGKPLGEGCFGQVVLAEAIGL
Consensus  (451)   SSGTPMLAGVSEYELPEDPRWELPRDRLVLGKPLGEGCFGQVVLAEAIGL
                    501                                               550
hu  FGFR1  (501)   DKDKPNRVTKVAVKMLKSDATEKDLSDLISEMEMMKMIGKHKNIINLLGA
    muFGFR1 (501)  DKDKPNRVTKVAVKMLKSDATEKDLSDLISEMEMMKMIGKHKNIINLLGA
Consensus  (501)   DKDKPNRVTKVAVKMLKSDATEKDLSDLISEMEMMKMIGKHKNIINLLGA
                    551                                               600
hu  FGFR1  (551)   CTQDGPLYVIVEYASKGNLREYLQARRPPGLEYCYNPSHNPEEQLSSKDL
    muFGFR1 (551)  CTQDGPLYVIVEYASKGNLREYLQARRPPGLEYCYNPSHNPEEQLSSKDL
Consensus  (551)   CTQDGPLYVIVEYASKGNLREYLQARRPPGLEYCYNPSHNPEEQLSSKDL
                    601                                               650
hu  FGFR1  (601)   VSCAYQVARGMEYLASKKCIHRDLAARNVLVTEDNVMKIADFGLARDIHH
    muFGFR1 (601)  VSCAYQVARGMEYLASKKCIHRDLAARNVLVTEDNVMKIADFGLARDIHH
Consensus  (601)   VSCAYQVARGMEYLASKKCIHRDLAARNVLVTEDNVMKIADFGLARDIHH
```

FIG.1B

```
                 651                                                        700
hu FGFR1   (651) IDYYKKTTNGRLPVKWMAPEALFDRIYTHQSDVWSFGVLLWEIFTLGGSP
  muFGFR1  (651) IDYYKKTTNGRLPVKWMAPEALFDRIYTHQSDVWSFGVLLWEIFTLGGSP
Consensus  (651) IDYYKKTTNGRLPVKWMAPEALFDRIYTHQSDVWSFGVLLWEIFTLGGSP
                 701                                                        750
hu FGFR1   (701) YPGVPVEELFKLLKEGHRMDKPSNCTNELYMMMRDCWHAVPSQRPTFKQL
  muFGFR1  (701) YPGVPVEELFKLLKEGHRMDKPSNCTNELYMMMRDCWHAVPSQRPTFKQL
Consensus  (701) YPGVPVEELFKLLKEGHRMDKPSNCTNELYMMMRDCWHAVPSQRPTFKQL
                 751                                                        800
hu FGFR1   (751) VEDLDRIVALTSNQEYLDLSMPLDQYSPSFPDTRSSTCSSGEDSVFSHEP
  muFGFR1  (751) VEDLDRIVALTSNQEYLDLSIPLDQYSPSFPDTRSSTCSSGEDSVFSHEP
Consensus  (751) VEDLDRIVALTSNQEYLDLSIPLDQYSPSFPDTRSSTCSSGEDSVFSHEP
                 801                822
hu FGFR1   (801) LPEEPCLPRHPAQLANGGLKRR
  muFGFR1  (801) LPEEPCLPRHPTQLANSGLKRR
Consensus  (801) LPEEPCLPRHP QLAN GLKRR
```

FIG. 2A

```
                    1                                                    50
hu beta Klotho   (1) MKPGCAAGSPGNEWIFFSTDEITTRYRNTMSNGGLQRSVILSALILLRAV
mu beta klotho   (1) MKTGCAAGSPGNEWIFFSSDERNTRSRKTMSNRALQRSAVLLSAFVLLRAV
Consensus        (1) MK GCAAGSPGNEWIFFSSDE   TR R TMSN ALQRS  ILSA  ILLRAV
                    51                                                  100
hu beta Klotho  (51) TGFSGDGRAIWSKNPNFTPVNESQLFLYDTFPKNFFWGIGTGALQVEGSW
mu beta klotho  (51) TGFSGDGKAIWDKKQYVSPVNPSQLFLYDTFPKNFSWGVGTGAFQVEGSW
Consensus       (51) TGFSGDGKAIW    SPVN SQLFLYDTFPKNF WGIGTGA QVEGSW
                    101                                                 150
hu beta Klotho (101) KKDGKGPSIWDHFTHTHLKNVSSTNGSSDSYIFLEKDLSALDFIGVSFYQ
mu beta klotho (101) KTDGRGPSIWDRVYSHLRGVNGTDRSTDSYIFLEKDLLALDFLGVSFYQ
Consensus      (101) K DGKGPSIWD FIHSHLK V T SSDSYIFLEKDL ALDFIGVSFYQ
                    151                                                 200
hu beta Klotho (151) FSISWPRLFPDGIVTVANAKGLQYYSTLLDALVLRNIEPIVTLYHWDLPL
mu beta klotho (151) FSISWPRLFPNGTVAAVNAQGLRYYRALLDSLVLRNIEPIVTLYHWDLPL
Consensus      (151) FSISWPRLFP G V   NA GL YY  LLDALVLRNIEPIVTLYHWDLPL
                    201                                                 250
hu beta Klotho (201) ALQEKYGGWKNDTIIDIFNDYATYCFQMFGDRVKYWITIHNPYLVAWHGY
mu beta klotho (201) TLQEEYGGWKNATMIDLFNDYATYCFQTFGDRVKYWITIHNPYLVAWHGF
Consensus      (201)  LQE YGGWKN  TIIDIFNDYATYCFQ FGDRVKYWITIHNPYLVAWHGF
                    251                                                 300
hu beta Klotho (251) GTGMHAPGEKGNLAAVYTVGHNLIKAHSKVWHNYNTHFRPHQKGWLSITL
mu beta klotho (251) GTGMHAPGEKGNLTAVYTVGHNLIKAHSKVWHNYDKNFRPHQKGWLSITL
Consensus      (251) GTGMHAPGEKGNL AVYTVGHNLIKAHSKVWHNY    FRPHQKGWLSITL
                    301                                                 350
hu beta Klotho (301) GSHWIEPNRSENTMDIFKCQQSMVSVLGWFANPIHGDGDYPEGMRKKLFS
mu beta klotho (301) GSHWIEPNRTDNMEDVINCQHSMSSVLGWFANPIHGDGDYPEFMKTG--A
Consensus      (301) GSHWIEPNRSDN   DI  CQ  SM SVLGWFANPIHGDGDYPE MK   A
```

FIG. 2B

```
                     351                                                  400
hu beta Klotho (351) VIPIFSEAEKHEMRGTADFFAFSFGPNNFKPLNTMAKMGQNVSINLREAL
mu beta klotho (349) MIPEFSEAEKEVRGTADFFAFSFGPNNFRPSNTVKMGQNVSLNLRQVL
     Consensus  (351) MIP FSEAEK  EMRGTADFFAFSFGPNNFKP NTM KMGQNVSLNLR   L
                     401                                                  450
hu beta Klotho (401) NWIKLEYNNPRILIAENGWFTDSRVKTEDTTAIYMMKNFLSQVLQAIRLD
mu beta klotho (399) NWIKLEYDDPQILISENGWFTDSYIKTEDTTAIYMMKNFLNQVLQAIKFD
     Consensus  (401) NWIKLEY   P ILIAENGWFTDS  IKTEDTTAIYMMKNFL QVLQAIK D
                     451                                                  500
hu beta Klotho (451) EIRVFGYTAWSLLDGFEWQDAYTIRRGLFYVDFNSKQERKPKSSAHYYK
mu beta klotho (449) EIRVFGYTAWTLLDGFEWQDAYTTRRGLFYVDFNSEQKERKPKSSAHYYK
     Consensus  (451) EIRVFGYTAWSLLDGFEWQDAYT RRGLFYVDFNS QKERKPKSSAHYYK
                     501                                                  550
hu beta Klotho (501) QIIRENGFSLKESTPDVQGQFPCDFSWGVTESVLKPESVASSPQFSDPHL
mu beta klotho (499) QIIQDNGFPLKESTPDMKGRFPCDFSWGVTESVLKPEFTVSSPQFTDPHL
     Consensus  (501) QII DNGF LKESTPDM G FPCDFSWGVTESVLKPE  SSPQFSDPHL
                     551                                                  600
hu beta Klotho (551) YVWNATGNRLLHRVEGVRLKTRPAQCTDEVNIKKQLEMLARMKVTHYRFA
mu beta klotho (549) YVWNVTGNRLLYVEGVRLKTRPSQCTDYVSIKKRVEMLAKMKVTHYQFA
     Consensus  (551) YVWN TGNRLLHRVEGVRLKTRPAQCTDFV IKK LEMLAKMKVTHY FA
                     601                                                  650
hu beta Klotho (601) LDWASVLPTGNLSAVNRQALRYRCVVSEGLKLGISAMVTLYPTHAHLG
mu beta klotho (599) LDWTSILPTGNLSKVNRQVLRYRCVVSEGLKLGVFPMVTLYHPTHSHLG
     Consensus  (601) LDW SILPTGNLS VNRQ LRYRCVVSEGLKLGI  MVTLYHPTHAHLG
                     651                                                  700
hu beta Klotho (651) LPEPLLHADGWLNPSTAEAFQAYAGLCFQELGDLVKLWITINEPNRLSDI
mu beta klotho (649) LPLPLLSSGGWLNMNTAKAFQDYAELCFRELGDLVKLWITINEPNRLSDM
     Consensus  (651) LP PLL A GWLN  TA AFQ YA LCF ELGDLVKLWITINEPNRLSDI
```

FIG. 2C

```
                      701                                                         750
hu beta Klotho  (701) YNRSGNDTYGAAHNLLVAHALAWRLYDRQFRPSQRGAVSLSLHADWAEPA
mu beta klotho  (699) YNRTSNDTYRAAHNLMIAHAQVWHLYDRQYRPVQHGAVSLSLHCDWAEPA
     Consensus  (701) YNRS NDTY AAHNLLIAHA  W LYDRQFRP Q GAVSLSLH DWAEPA
                      751                                                         800
hu beta Klotho  (751) NPYADSHWRAAERFLQFEIAWFAEPLFKTGDYPAAMREYIASKHRRGLSS
mu beta klotho  (749) NPFVDSHWKAAERFLQFEIAWFADPLFKTGDYPSVMKEYIASKNQRGLSS
     Consensus  (751) NPF DSHWKAAERFLQFEIAWFADPLFKTGDYPA MKEYIASK RGLSS
                      801                                                         850
hu beta Klotho  (801) SALPRLTEAERRLLKGTVDFCALNHFTTRFVMHEQLAGSRYDSDRDIQFL
mu beta klotho  (799) SVLPRFTAKESRLVKGTVDFYALNHFTTRFVIHKQLNTNRSVADRDVQFL
     Consensus  (801) S LPR T E RLLKGTVDF ALNHFTTRFVIH QL  R  ADRDIQFL
                      851                                                         900
hu beta Klotho  (851) QDITRLSSPTRLAVIPWGVRKLLRWVRRNYGDMDIYITASGIDDQALEDD
mu beta klotho  (849) QDITRLSSPSRLAVTPWGVRKLLAWIRRNYRDRDIYITANGIDDLALEDD
     Consensus  (851) QDITRLSSPSRLAV PWGVRKLL WIRRNY D DIYITA GIDD ALEDD
                      901                                                         950
hu beta Klotho  (901) RLRKYYLGKYLQEVLKAYLIDKVRIKGYYAFKLAEEKSKPRFGFFTSDFK
mu beta klotho  (899) QIRKYYLEKYQEALKAYLIDKVKIKGYYAFKLTEEKSKPRFGFFTSDFR
     Consensus  (901) IRKYYL KYLQE LKAYLIDKVKIKGYYAFKL EEKSKPRFGFFTSDFK
                      951                                                        1000
hu beta Klotho  (951) AKSSIQFYNKVISSRGFPFENSSSRCSQTQENTECTVCLFLVQKKPLIFL
mu beta klotho  (949) AKSSVQFYSKLISSSGLPAENRSPACGQPAEDTDCTICSFIVEKKPLIFF
     Consensus  (951) AKSSIQFY KLISS G P EN S  C Q  E TDCTIC FLV KKPLIF
                     1001                                          1045
hu beta Klotho (1001) GCCFFSTLVLLSIAIFQRQKRRKFWKAKNLQHIPLKKGKRVVS-
mu beta klotho  (999) GCCFISTLAVLLSITVFHHQKRRKFQKARNLQNIPLKKGHSRVFS
     Consensus (1001) GCCF STL LLLSI IF  QKRRKF KAKNLQ IPLKKG    V
```

AM-1 Parental-Unstained
DB120707-AM1 Unstained

AM-1 /bKlotho +FGFR1 pool 3 - Unstained
DB120707-Pool3 Unstained

CHO/bKlotho+FGFR1 pool 5- Unstained
DB120707-Pool5 Unstained

AM-1 parental + Alexa647-FGF21
DB120707-AM1 Unstained

AM-1 /bKlotho +FGFR1 pool 3 + Alexa647-FGF21
DB120707-Pool3 Sort

CHO/bKlotho + FGFR1 pool 5 + Alexa647-FGF21
DB120707-Pool5 Sort

FIG. 4

DPSPTLPEQAQPWGAPVEVESFLVHPGDLLQLRCRLRDDVQSINWLRDGVQL
AESNRTRITGEEVEVQDSVPADSGLYACVTSSPSGSDTTYFSVNVSDALPSS
EDDDDDDDSSSEEKETDNTKPNRMPVAPYWTSPEKMEKKLHAVPAAKTVKFK
CPSSGTPNPTLRWLKNGKEFKPDHRIGGYKVRYATWSIIMDSVVPSDKGNYT
CIVENEYGSINHTYQLDVVERSPHRPILQAGLPANKTVALGSNVEFMCKVYS
DPQPHIQWLKHIEVNGSKIGPDNLPYVQILKTAGVNTTDKEMEVLHLRNVSF
EDAGEYTCLAGNSIGLSHHSAWLTVLEALEERPAVMTSPLY*ggggg*dkthtc
ppcpapellggpsvflfppkpkdtlmisrtpevtcVvvdvshedpevkfnwy
vdgvevhnaktkpreeqynstyrvvsvltvlhqdwlngkeyKckvsnkalpa
piektiskakgqprepqvytlppsrdeltknqvsltclvkgfypsdiavewE
sngqpennykttppvldsdgsfflyskltvdksrwqqgnvfscsvmhealhn
hytqkslslspgk

FIG. 5

FSGDGRAI WSKNPNFTPV NESQLFLYDT FPKNFFWGIG TGALQVEGSW
KKDGKGPSIW DHFIHTHLKN VSSTNGSSDS YIFLEKDLSA LDFIGVSFYQ
FSISWPRLFP DGIVTVANAK GLQYSTLLD YIFLEKDLSA LDFIGVSFYQ
FSISWPRLFP DGIVTVANAK GLQYSTLLD ALVLRNIEPI VTLYHWDLPL
ALQEKYGGWK NDTIIDIFND YATYCFQMFG DRVKYWITIH NPYLVAWHGY
GTGMHAPGEK GNLAAVYTVG HNLIKAHSKV WHNYNTHFRP HQKGWLSITL
GSHWIEPNRS ENTMDIFKCQ QSMVSVLGWF ANPIHGDGDY PEGMRKKLFS
VLPIFSEAEK HEMRGTADFF AFSFGPNNFK PLNTMAKMGQ NVSLNLREAL
NWIKLEYNNP RILIAENGWF TDSRVKTEDT TAIYMKNFL SQVLQAIRLD
EIRVFGYTAW SLLDGFEWQD AYTIRRGLFY VDFNSKQKER KPKSSAHYYK
QIIRENGFSL KESTPDVQGQ FPCDFSWGVT ESVLKPESVA SSPQFSDPHL
YVWNATGNRL LHRVEGVRLK TRPAQCTDFV NIKKQLEMLA RMKVTHYRFA
LDWASVLPTG NLSAVNRQAL RYRCVVSEG LKLGISAMVT LYYPTHAHLG
LPEPLLHADG WLNPSTAEAF QAYAGLCFQE LGDLVKLWIT INEPNRLSDI
YNRSGNDTYG AAHNLLVAHA LAWRLYDRQF RPSQRGAVSL SLHADWAEPA
NPYADSHWRA AERFLQFEIA WFAEPLFKTG DYPAAMREYI ASKHRRGLSS
SALPRLTEAE RRLLKGTVDF CALNHFTTRF VMHEQLAGSR YDSDRDIQFL
QDITRLSSPT RLAVIPWGVR KLLRWVRRNY GDMDIYITAS GIDDQALEDD
RLRKYYLGKY LQEVLKAYLI DKVRIKGYYA FKLAEEKSKP RFGFFTSDFK
AKSSIQFYNK VISSRGFPFE NSSSRCSQTQ ENTECTVCLF LVQKKP
ggggdkthtcppcpapellggpsvflfppkpkdtlmisrtpevtcvvvdvshe
dpevkfnwyvdgvevhnaktkpreeqynstYrvvsvltvlhqdwlngkeykckv
snkalpapiektiskakgqprepqvtlppsrdeltknqvsltclvkgfypsdi
avewesngqpennykttppvldsdgsfflyskltvdksrwqqgnvfscsvmhea
lhnhytqkslslspgk 1. Mol. wt. markers
2. Heterodimer, non-reducing
3. Stds
4. Heterodimer, reducing
5. Mol. wt. markers

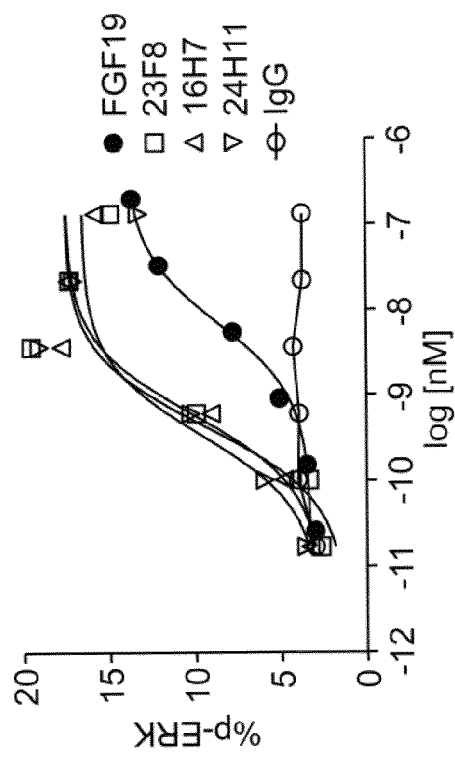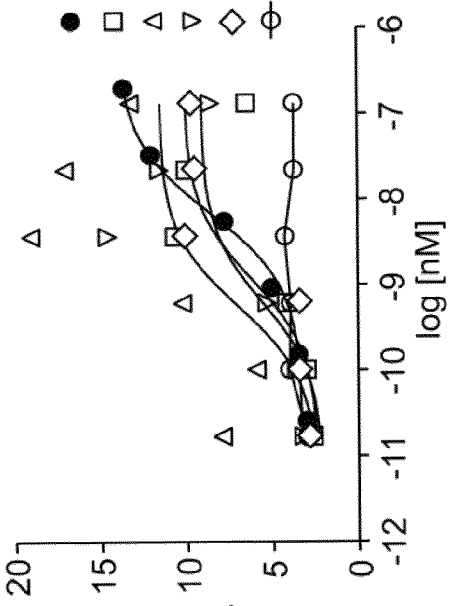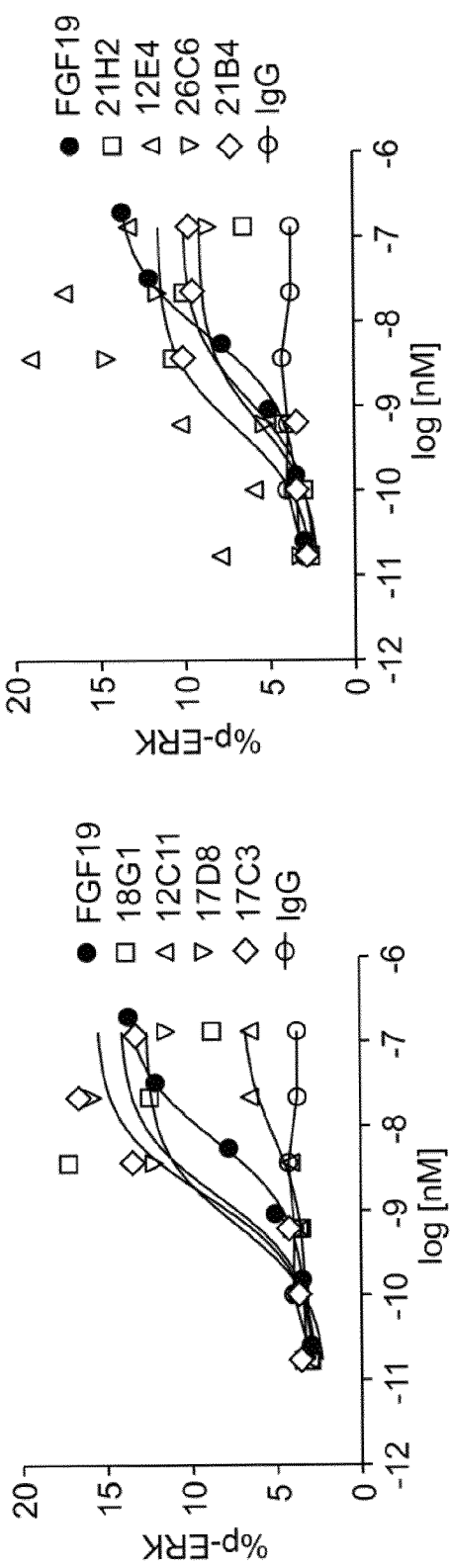

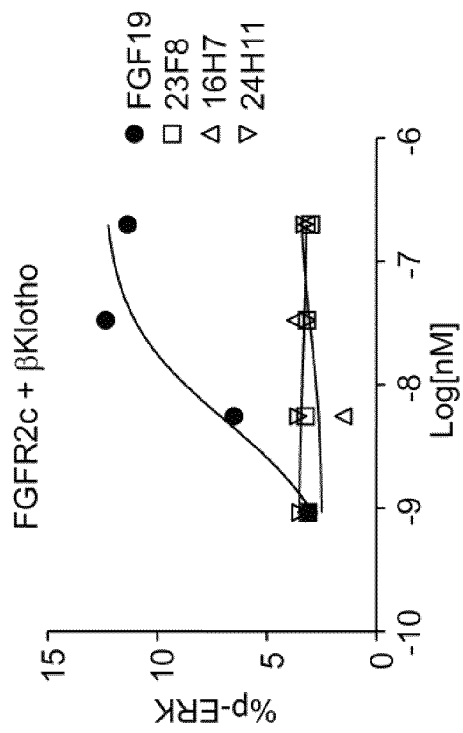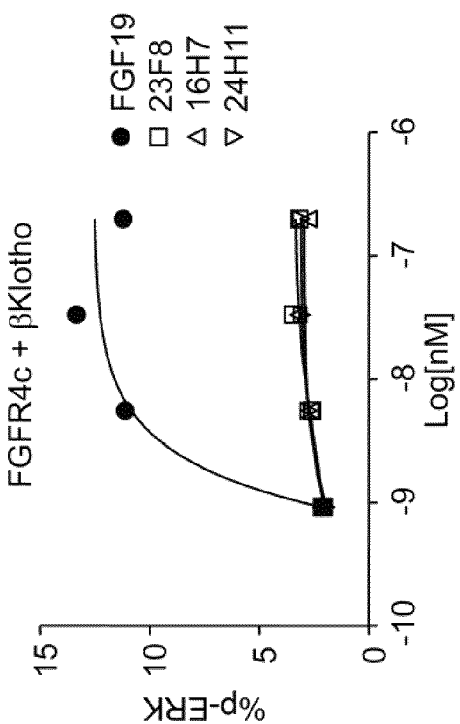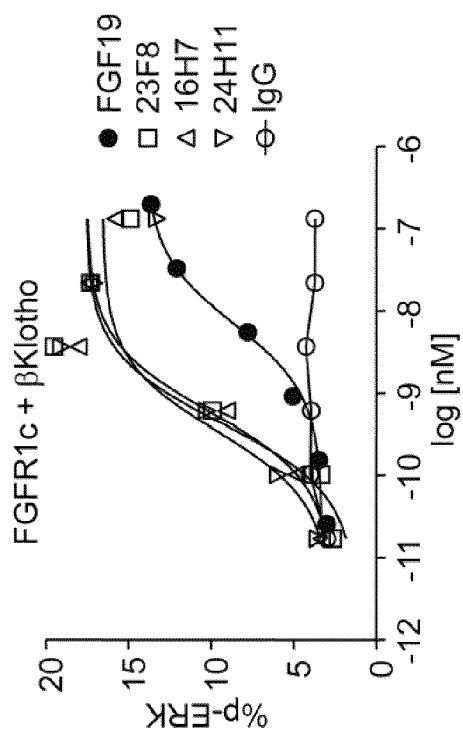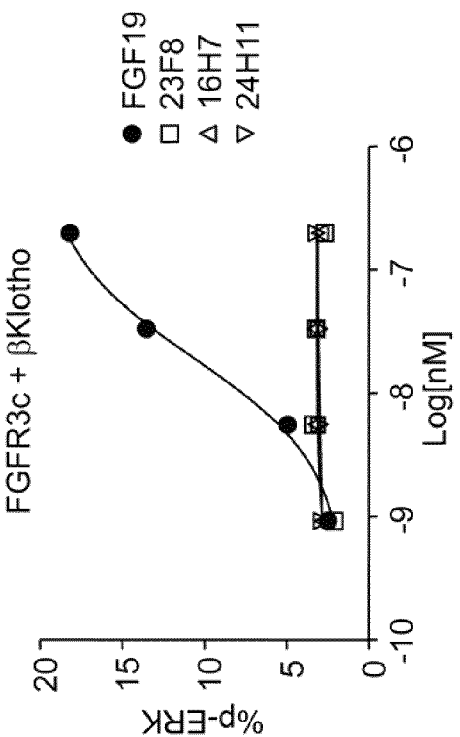

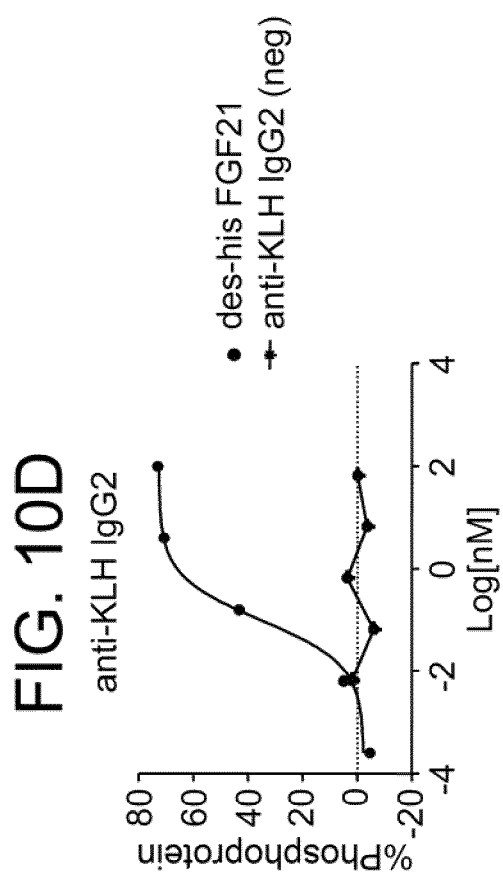
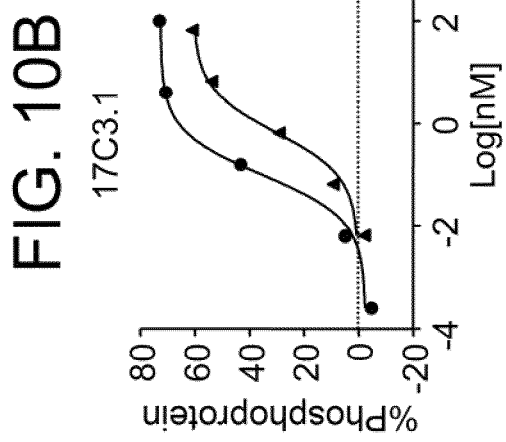
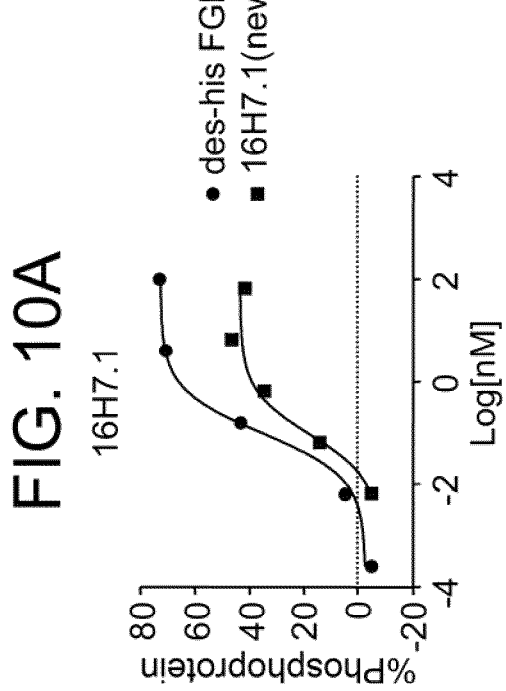
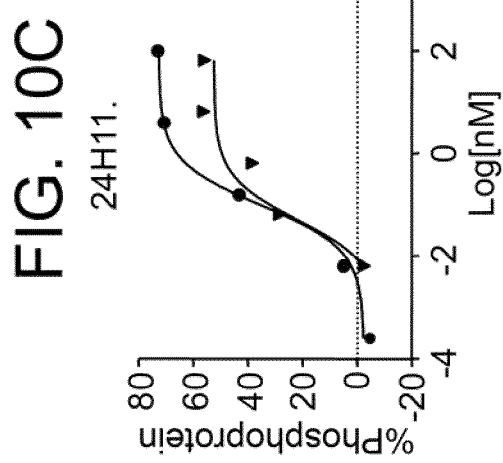

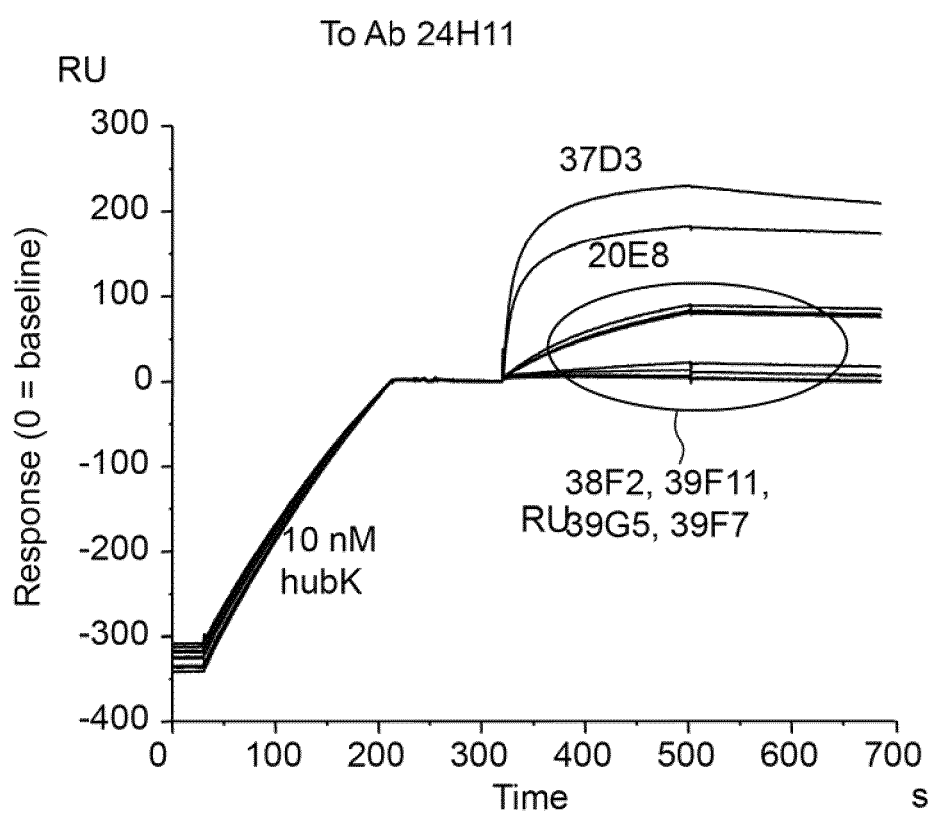

FIG. 11G

Epitope Binning Summary

24H11 Bin: 2nd Campaign – 24H11, 17C3, 16H7, 20D4, 21B4, 22H5, 23F8, 21H2, 18B11; 3rd Campaign – 40D2, 46D11

17D8 Bin: 2nd Campaign – 17D8, 12C11, 26H11, 12E4, 18G1; 3rd Campaign – 37D3

39F7 Bin: 3rd Campaign – 39F7, 38F2, 39F11, 39G5

20E8 Bin: 2nd Campaign – 20E8

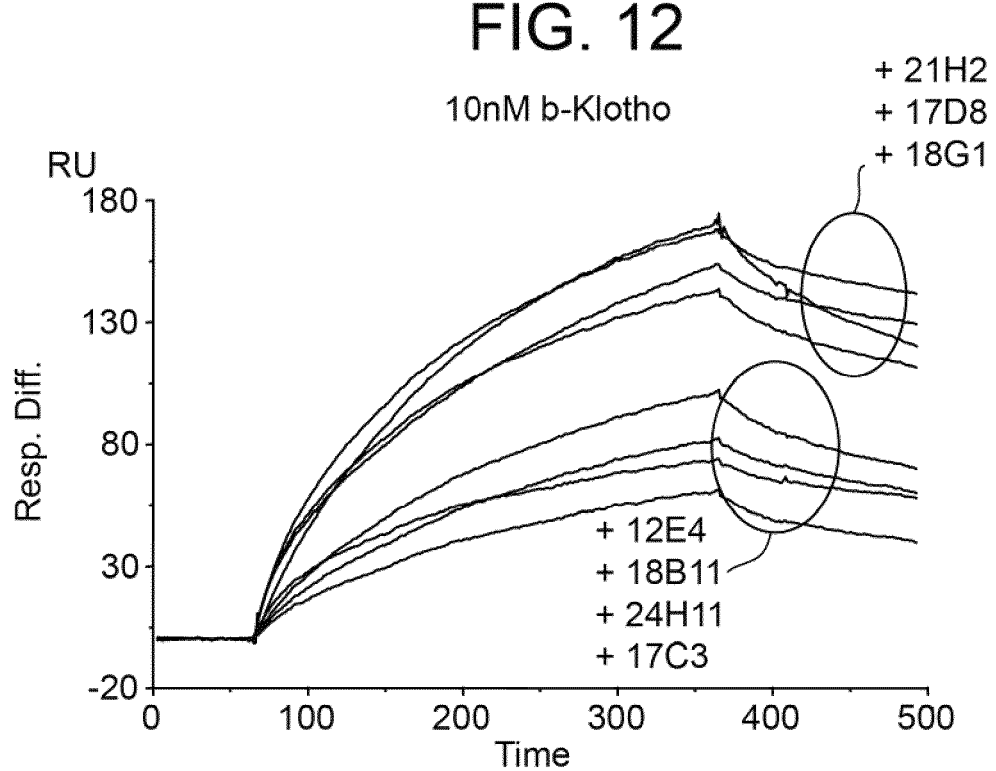

FIG. 13A

| Light chain | | | |
|---|---|---|---|
| | Germline | Germline | FR1 |
| | | | DIQMTQSPSSLSASVGDRVTITC |
| 20D4 | VK1\|A30 | JK4 | ---L----------I-------- |
| | | | |
| | Germline | Germline | FR1 |
| | | | DIQMTQSPSSVSASVGDRVTITC |
| 46D11 | VK1\|L5 | JK5 | ------------------------ |
| | | | |
| | Germline | Germline | FR1 |
| | | | DIVMTQTPLSLSVTPGQPASISC |
| 40D2=36F2=39C2 | VK2\|A18 | JK1 | -F---------------------- |
| | | | |
| | Germline | Germline | FR1 |
| | | | DIVMTQSPLSLPVTPGEPASISC |
| 37D3 | VK2\|A19 | JK2 | ------------------------ |
| | | | |
| | Germline | Germline | FR1 |
| | | | DIVMTQSPLSLPVTPGEPASISC |
| 18B11 LC#1 | VK2\|A19 | JK3 | ------------------------ |
| | | | |
| | Germline | Germline | FR1 |
| | | | EIVLTQSPGTLSLSPGERATLSC |
| 12C11 | VK3\|A27 | JK4 | ------------------------ |
| 18G1 | VK3\|A27 | JK4 | ------------------------ |
| 17D8 | VK3\|A27 | JK4 | ------------------------ |
| 21B4 | VK3\|A27 | JK4 | ------------------------ |
| 21H2 | VK3\|A27 | JK4 | ------------------------ |
| 26H11 | VK3\|A27 | JK4 | ------------------------ |
| 12E4 | VK3\|A27 | JK4 | ------------------------ |
| 39F7=47E3=38F2 | VK3\|A27 | JK4 | ------------------------ |
| 39F11=41H5=37G3=39G8 | VK3\|A27 | JK4 | ------------------------ |
| 39G5 | VK3\|A27 | JK4 | ------------------------ |
| | | | |
| | Germline | Germline | FR1 |
| | | | EIVMTQSPATLSVSPGERATLSC |
| 18B11 LC#2 | VK3\|L2 | JK1 | ------------------------ |
| | | | |
| | Germline | Germline | FR1 |
| | | | SYVLTQPPSVSVAPGKTARITC |
| 16H7=23F8 | VL3\|3h | JL3 | ----------------Q------ |
| 24H11 | VL3\|3h | JL3 | ----------------Q------ |
| 22H5 | VL3\|3h | JL3 | ----------------Q------ |
| 17C3 | VL3\|3h | JL3 | ----------------Q------ |

FIG. 13B

| Heavy chain | | | |
|---|---|---|---|
| | Germline | Germline | FR1 |
| | | | QVQLVQSGAEVKKPGASVKVSCKVSGYTLT |
| 20D4 | VH1\|124 | JH6 | -------------------------------- |
| | | | |
| | Germline | Germline | FR1 |
| | | | QVTLKESGPVLVKPTETLTLTCTVSGFSLS |
| 17C3 | VH2\|226 | JH6 | -------------------------------- |
| 22H5 | VH2\|226 | JH6 | -------------------------------- |
| 16H7=23F8 | VH2\|226 | JH6 | ----------------------------N |
| 24H11 | VH2\|226 | JH6 | -------------------------------- |
| 46D11 | VH2\|226 | JH6 | ------A------------------------- |
| | | | |
| | Germline | Germline | FR1 |
| | | | EVQLVESGGGLVKPGGSLRLSCAASGFTFS |
| 18B11 | VH3\|315 | JH6 | -------------------------------- |
| 37D3 | VH3\|315 | JH6 | --H--------A------------------R |
| | | | |
| | Germline | Germline | FR1 |
| | | | EVQLLESGGGLVQPGGSLRLSCAASGFTFS |
| 18G1 | VH3\|323 | JH4 | -------------------------R---- |
| 12C11 | VH3\|323 | JH4 | -------------------------R---- |
| 12E4 | VH3\|323 | JH4 | -------------------------R---- |
| 17D8 | VH3\|323 | JH4 | ------------------Y------------- |
| 26H11 | VH3\|323 | JH4 | ------------------Y------------- |
| | | | |
| | Germline | Germline | FR1 |
| | | | QVQLVESGGGVVQPGRSLRLSCAASGFTFS |
| 39F11=41H5=37G3=39G8 | VH3\|333 | JH6 | -------------------------------- |
| 39F7=47E3=38F2 | VH3\|333 | JH6 | -------------------------------- |
| 39G5 | VH3\|333 | JH6 | ----------------------V------- |
| | | | |
| | Germline | Germline | FR1 |
| | | | QVQLQESGPGLVKPSQTLSLTCTVSGGSIS |
| 40D2=36F2=39C2 | VH4\|431 | JH5 | -------------------------------- |
| | | | |
| | Germline | Germline | FR1 |
| | | | QVQLQESGPGLVKPSETLSLTCTVSGGSIS |
| 21B4 | VH4\|459 | JH6 | -------------------------------- |
| 21H2 | VH4\|459 | JH6 | -------------------------------- |

FIG. 13C

| CDR1 | FR2 | CDR2 |
|---|---|---|
| RASQGIRNDLG | WYQQKPGKAPKRLIY | AASSLQS |
| ----D--Y--- | ---------------- | ------- |
| CDR1 | FR2 | CDR2 |
| RASQGISSWLA | WYQQKPGKAPKLLIY | AASSLQS |
| --------I--- | ---------------- | ------- |
| CDR1 | FR2 | CDR2 |
| KSSQSLLHSDGKTYLY | WYLQKPGQSPQLLIY | EVSSRFS |
| -------Q-------- | --------P-H---- | ---N--- |
| CDR1 | FR2 | CDR2 |
| RSSQSLLHSNGYNYLD | WYLQKPGQSPQLLIY | LGSNRAS |
| -------------F-- | ---------------- | ---D--- |
| CDR1 | FR2 | CDR2 |
| RSSQSLLHSNGYNYLD | WYLQKPGQSPQLLIY | LGSNRAS |
| -------YY--FT--- | -F--------H---- | ------- |
| CDR1 | FR2 | CDR2 |
| RASQSVSSSYLA | WYQQKPGQAPRLLIY | GASSRAT |
| ----NFD--S-- | ---------------- | ------- |
| ----NFD----- | ---------------- | -T----- |
| -------GN--- | ---------------- | ------- |
| --------T--- | -H------GL----- | ------- |
| --------T--- | -H------GL----- | ------- |
| -------GN--- | ---------------- | ------- |
| ----NFD-N--- | ---------------- | ------- |
| --------T--- | ---------------- | ------- |
| --------T--- | -----------S---- | ------- |
| --------T--- | ---------------- | ---F--- |
| CDR1 | FR2 | CDR2 |
| RASQSVSSNLA | WYQQKPGQAPRLLIY | GASTRAT |
| -------N---- | ---------------- | -V----- |
| CDR1 | FR2 | CDR2 |
| GGNNIGSKSVH | WYQQKPGQAPVLVIY | YDSDRPS |
| -------E--- | --------------V- | D------ |
| -------E--- | --------------V- | D------ |
| -------Q--- | --------------V- | D------ |
| -------Q--- | --------------V- | D------ |

FIG. 13D

| CDR1 | FR2 | CDR2 |
|---|---|---|
| ELSMH | WVRQAPGKGLEWMG | GFDPEDGETIYAQKFQG |
| D---- | --------------- | ----------------- |

| CDR1 | FR2 | CDR2 |
|---|---|---|
| NARMGVS | WIRQPPGKALEWLA | HIFSNDEKSYSTSLKS |
| ------- | -------------- | ---------------- |
| ------- | -------------- | ---------------- |
| ------- | -------------- | ---------------- |
| ------- | -------------- | ---------------N |
| ------N | -------------- | ---------------- |

| CDR1 | FR2 | CDR2 |
|---|---|---|
| NAWMS | WVRQAPGKGLEWVG | RIKSKTDGGTTDYAAPVKG |
| D---- | -------------- | ------------------- |
| ----- | -------------- | ------------------- |

| CDR1 | FR2 | CDR2 |
|---|---|---|
| SYAMS | WVRQAPGKGLEWVS | AISGSGGSTYYADSVKG |
| T---- | -------------- | G-----V--H------- |
| T---- | -------------- | G-----V---------- |
| T---- | -------------- | G-----V---------- |
| T---- | -------------- | ------V---------- |
| T---- | -------------- | ------V--N------- |

| CDR1 | FR2 | CDR2 |
|---|---|---|
| SYGMH | WVRQAPGKGLEWVA | VIWYDGSNKYYADSVKG |
| ---I- | -------------- | -------D--------- |
| N--I- | -------------- | -------I--------- |
| ---I- | -------------- | -------D---G----- |

| CDR1 | FR2 | CDR2 |
|---|---|---|
| SGGYYWS | WIRQHPGKGLEWIG | YIYYSGSTYYNPSLKS |
| ----N-- | -------------- | N--------------- |

| CDR1 | FR2 | CDR2 |
|---|---|---|
| SYYWS | WIRQPPGKGLEWIG | YIYYSGSTNYNPSLKS |
| --F-- | -----A-------- | R--T------------ |
| ----- | -----A-------- | R--T------------ |

FIG. 13E

| FR3 | CDR3 | FR4 |
|---|---|---|
| GVPSRFSGSGSGTEFTLTISSLQPEDFATYYC | | |
| ------------------V------------ | LQHNSYPLT | FGGGTKVEIE |

| FR3 | CDR3 | FR4 |
|---|---|---|
| GVPSRFSGSGSGTDFTLTISSLQPEDFATYYC | | |
| -------------------------------- | QQANDFPIT | FGQGTRLEIK |

| FR3 | CDR3 | FR4 |
|---|---|---|
| GVPDRFSGSGSGTDFTLKISRVEAEDVGVYYC | | |
| -------------------------------- | MQSIQLPRT | FGQGTKVEIK |

| FR3 | CDR3 | FR4 |
|---|---|---|
| GVPDRFSGSGSGTDFTLKISRVEAEDVGVYYC | | |
| ---------------E--------------L--- | MQALQTPCS | FGQGTKLEIK |

| FR3 | CDR3 | FR4 |
|---|---|---|
| GVPDRFSGSGSGTDFTLKISRVEAEDVGVYYC | | |
| ----------V---------------------- | MQSLQTPFT | FGPGTKVDIK |

| FR3 | CDR3 | FR4 |
|---|---|---|
| GIPDRFSGSGSGTDFTLTISRLEPEDFAVYYC | | |
| --------------------------------M--- | QQCGSSPLT | FGGGTKVEIK |
| ----------I----------N--------M--- | QQYGGSPLT | FGGGTEVEIK |
| -------------------------------- | QQYGSAPLT | FGGGTKVEIK |
| -------------------------------- | QQYGSSFT | FGGGTRVEIK |
| -------------------------------- | QQYGSSFT | FGGGTRVEIK |
| --------------------------------M--- | QQYGSSPLT | FGGGSKVEIK |
| ----N-----------------------M--- | QQYGSSPLT | FGGGTKVEIK |
| -------------------------------- | QQSGSSPLT | FGGGTEVEIK |
| -------------------------------- | QQSGSSPLT | FGGGTKVEIK |
| -------------------------------- | QQSGSSPLT | FGGGTKVEIK |

| FR3 | CDR3 | FR4 |
|---|---|---|
| GIPARFSGSGSGTEFTLTISSLQSEDFAVYYC | | |
| --------------------R------------ | QQYNNWPPT | FGQGTKVEIK |

| FR3 | CDR3 | FR4 |
|---|---|---|
| GIPERFSGSNSGNTATLTISRVEAGDEADYYC | | |
| -------------------------------- | QVWDGNSDHVV | FGGGTKLTVL |
| -------------------------------- | QVWDGNSDHVV | FGGGTKLTVL |
| -------------------------------- | QVWDNTSDHVV | FGGGTKLTVL |
| -------------------------------- | QVWDSSSDHVV | FGGGTKLTVL |

FIG. 13F

| FR3 | CDR3 | FR4 |
|---|---|---|
| RVTMTEDTSTDTAYMELSSLRSEDTAVYYCAT | | |
| -I---------------------------S | IVVVPAAIQSYYYYYGMGV | WGQGTTVTVSS |

| FR3 | CDR3 | FR4 |
|---|---|---|
| RLTISKDTSKSQVVLTMTNMDPVDTATYYCAR | | |
| ------------------------------------ | ILLLGAYYYYGMDV | WGQGTTVTVSS |
| ------------------------------------ | ILLVGAYYYCGMDV | WGQGTTVTVSS |
| -----------------I------------------ | SVVTGGYYYDGMDV | WGQGTTVTVSS |
| -----------------I------------------ | SVVTGGYYYDGMDV | WGQGTTVTVSS |
| ------------------------------------ | VRIAGDYYYYYGMDV | WGQGTTVTVSS |

| FR3 | CDR3 | FR4 |
|---|---|---|
| RFTISRDDSKNTLYLQMNSLKTEDTAVYYCTT | | |
| -----------------------F--S | TYSSGWYVWDYYGMDV | WGQGTTVTVSS |
| --------------------------E---I- | DRVLSYYAMAV | WGQGTTVTVSS |

| FR3 | CDR3 | FR4 |
|---|---|---|
| RFTISRDNSKNTLYLQMNSLRAEDTAVYYCAK | | |
| ------------------------------------ | SLIVVIVYALDH | WGQGTLVTVSS |
| ------------------------------------ | SLIVVIVYALDY | WGQGTLVTVSS |
| ------------------------------------ | SLIVVIVYALDY | WGQGTLVTVSS |
| ------------------------------------ | SLIVVMVYVLDY | WGQGTLVTVSS |
| ------------------------------------ | SLIVVMVYVLDY | WGQGTLVTVSS |

| FR3 | CDR3 | FR4 |
|---|---|---|
| RFTISRDNSKNTLYLQMNSLRAEDTAVYYCAR | | |
| ------------------------------------ | DRAAAGLHYYYGMDV | WGQGTTVTVSS |
| ------------------------------------ | DRAAAGLHYYYGMDV | WGQGTTVTVSS |
| ------------------------------------ | DRAAAGLHYYYGMDV | WGQGTTVTVSS |

| FR3 | CDR3 | FR4 |
|---|---|---|
| RVTISVDTSKNQFSLKLSSVTAADTAVYYCAR | | |
| -----------------R---------------- | ENIVVIPAAIFAGWFDP | WGQGTLVTVSS |

| FR3 | CDR3 | FR4 |
|---|---|---|
| RVTISVDTSKNQFSLKLSSVTAADTAVYYCAR | | |
| ---M-I---------------------- | DPDGDYYYYGMDV | WGQGTTVTVSS |
| ---M-K----------R------------- | DPDGDYYYYGMDV | WGQGTSVTVSS |

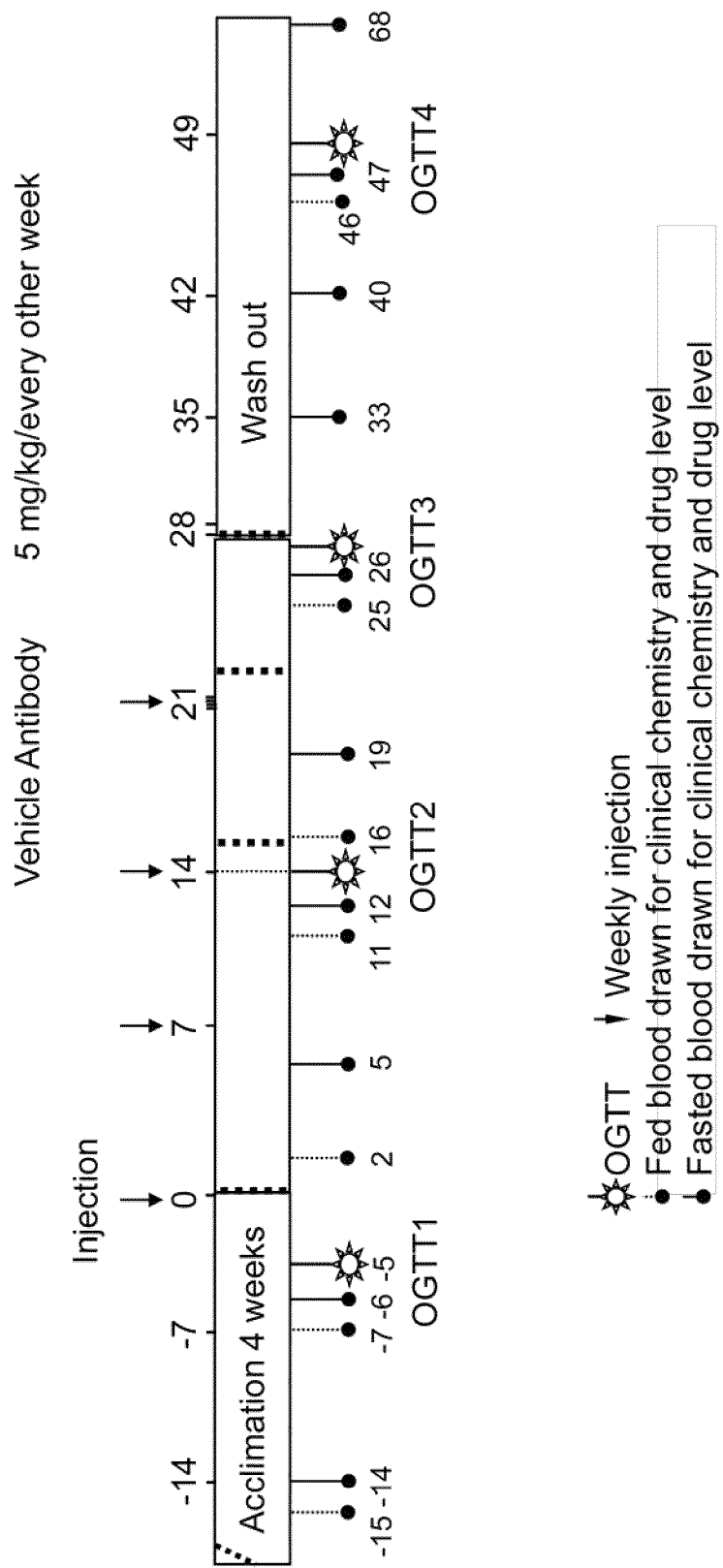

*p<0.05; p<0.01*p<0.001 versus Vehicle

*p<0.05; p<0.01*p<0.001 versus Vehicle

*p<0.05; p<0.01; *p<0.001 versus Vehicle

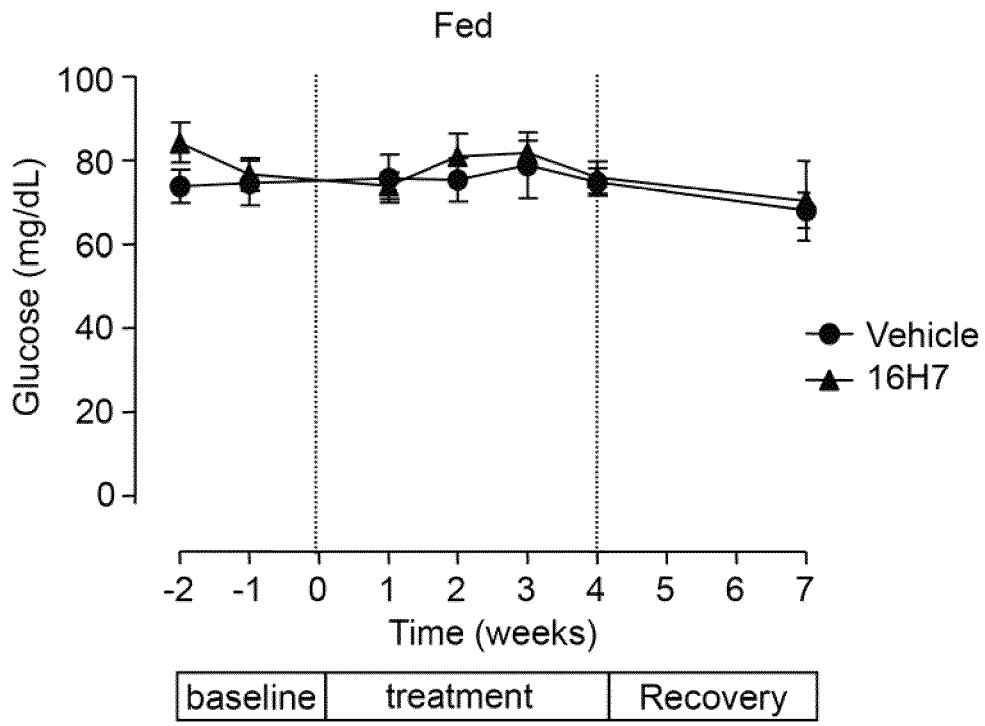
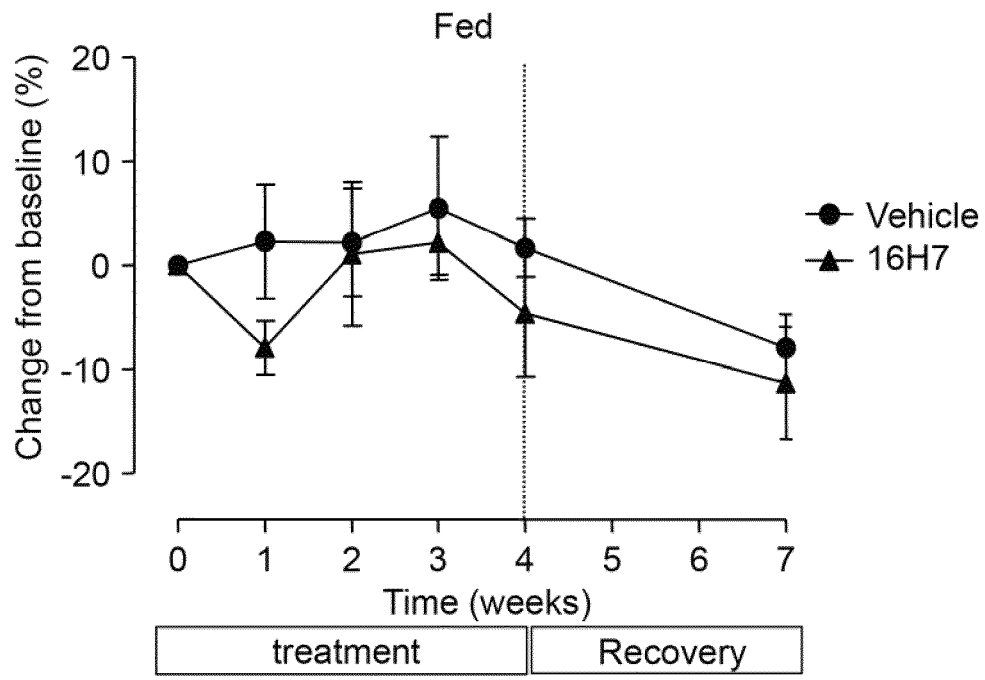

*p<0.05; p<0.01; *p<0.001 versus Vehicle

*p<0.05; p<0.01; *p<0.001 versus Vehicle

Fed

*p<0.05; p<0.01; *p<0.001 versus Vehicle

Fed

FIG. 30

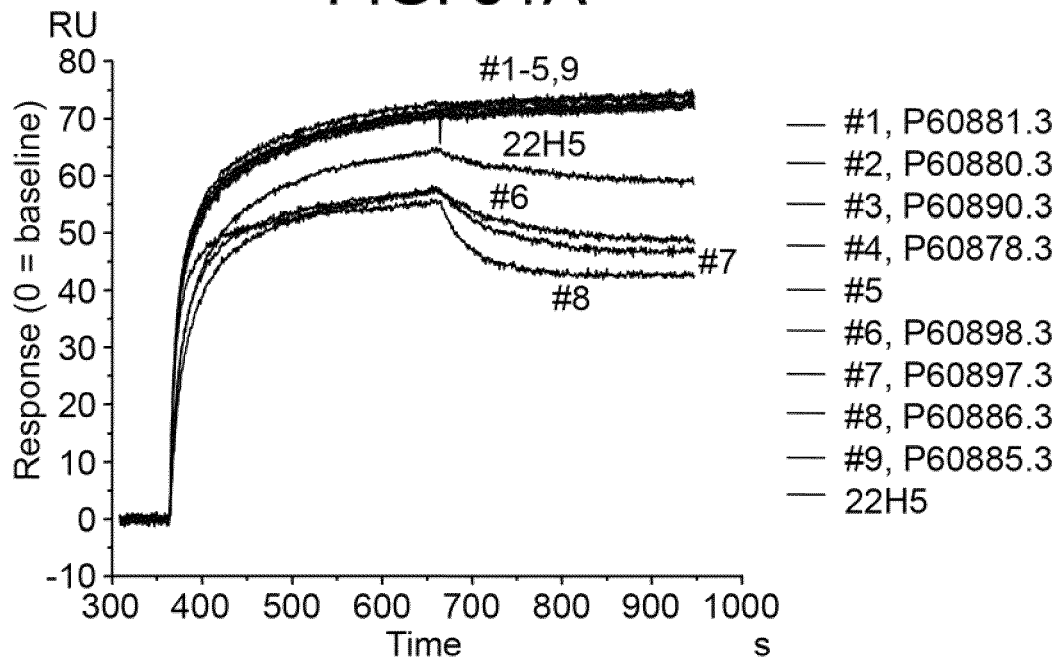
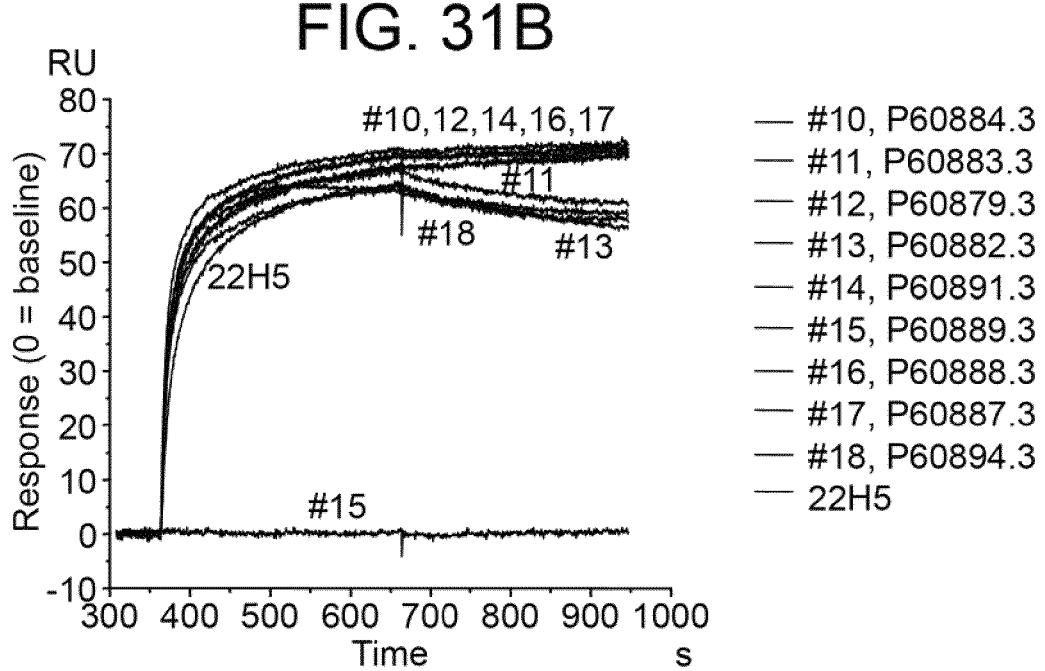

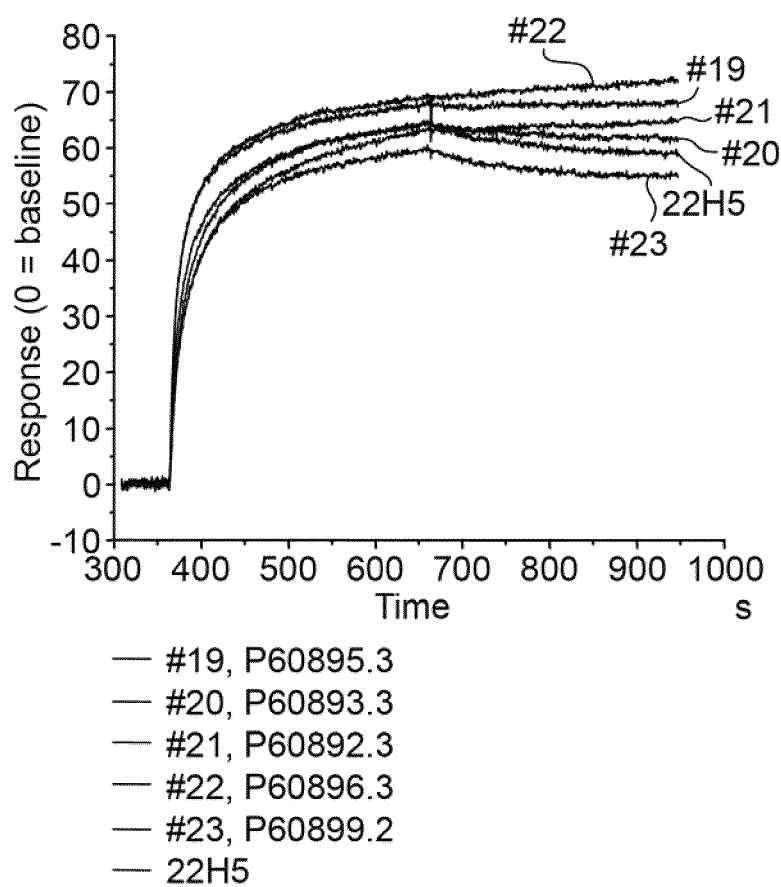

39F11

FGF21

HUMAN ANTIGEN BINDING PROTEINS THAT BIND β-KLOTHO, FGF RECEPTORS AND COMPLEXES THEREOF

This application claims the benefit of U.S. Provisional Application No. 61/267,321 filed Dec. 7, 2009 and U.S. Provisional Application No. 61/381,846 filed Sep. 10, 2010, which are incorporated by reference herein.

SEQUENCE LISTING

The instant application contains a Sequence Listing which has been submitted in ASCII format via EFS-Web and is hereby incorporated by reference in its entirety. Said ASCII copy, created on Nov. 24, 2010, is named A-1519-NP.txt and is 645,894 bytes in size.

FIELD OF THE INVENTION

The present disclosure relates to nucleic acid molecules encoding antigen binding proteins that bind to (i) β-Klotho; (ii) FGFR1c, FGFR2c, FGFR3c or FGFR4; or (iii) a complex comprising β-Klotho and one of FGFR1c, FGFR2c, FGFR3c, and FGFR4. The present disclosure also provides antigen binding proteins that bind to (i) β-Klotho; (ii) FGFR1c, FGFR2c, FGFR3c or FGFR4; or (iii) a complex comprising β-Klotho and one of FGFR1c, FGFR2c, FGFR3c, and FGFR4, including antigen binding proteins that induce FGF21-like signaling, as well as pharmaceutical compositions comprising antigen binding proteins that bind to (i) β-Klotho; (ii) FGFR1c, FGFR2c, FGFR3c or FGFR4; or (iii) a complex comprising β-Klotho and one of FGFR1c, FGFR2c, FGFR3c, and FGFR4, including antigen binding proteins that induce FGF21-like signaling, and methods for treating metabolic disorders using such nucleic acids, polypeptides, or pharmaceutical compositions. Diagnostic methods using the antigen binding proteins are also provided.

BACKGROUND

Fibroblast Growth Factor 21 (FGF21) is a secreted polypeptide that belongs to a subfamily of Fibroblast Growth Factors (FGFs) that includes FGF19, FGF21, and FGF23 (Itoh et al., (2004) *Trend Genet.* 20:563-69). FGF21 is an atypical FGF in that it is heparin independent and functions as a hormone in the regulation of glucose, lipid, and energy metabolism.

It is highly expressed in liver and pancreas and is the only member of the FGF family to be primarily expressed in liver. Transgenic mice overexpressing FGF21 exhibit metabolic phenotypes of slow growth rate, low plasma glucose and triglyceride levels, and an absence of age-associated type 2 diabetes, islet hyperplasia, and obesity. Pharmacological administration of recombinant FGF21 protein in rodent and primate models results in normalized levels of plasma glucose, reduced triglyceride and cholesterol levels, and improved glucose tolerance and insulin sensitivity. In addition, FGF21 reduces body weight and body fat by increasing energy expenditure, physical activity, and metabolic rate. Experimental research provides support for the pharmacological administration of FGF21 for the treatment of type 2 diabetes, obesity, dyslipidemia, and other metabolic conditions or disorders in humans.

FGF21 is a liver derived endocrine hormone that stimulates glucose uptake in adipocytes and lipid homeostasis through the activation of its receptor. Interestingly, in addition to the canonical FGF receptor, the FGF21 receptor also comprises the membrane associated β-Klotho as an essential cofactor. Activation of the FGF21 receptor leads to multiple effects on a variety of metabolic parameters.

In mammals, FGFs mediate their action via a set of four FGF receptors, FGFR1-4, that in turn are expressed in multiple spliced variants, e.g., FGFR1c, FGFR2c, FGFR3c and FGFR4. Each FGF receptor contains an intracellular tyrosine kinase domain that is activated upon ligand binding, leading to downstream signaling pathways involving MAPKs (Erk1/2), RAFT, AKT1 and STATs. (Kharitonenkov et al., (2008) *BioDrugs* 22:37-44). Several reports suggested that the "c"-reporter splice variants of FGFR1-3 exhibit specific affinity to β-Klotho and could act as endogenous receptor for FGF21 (Kurosu et al., (2007) *J. Biol. Chem.* 282:26687-26695); Ogawa et al., (2007) *Proc. Natl. Acad. Sci. USA* 104:7432-7437); Kharitonenkov et al., (2008) *J. Cell Physiol.* 215:1-7). In the liver, which abundantly expresses both β-Klotho and FGFR4, FGF21 does not induce phosphorylation of MAPK albeit the strong binding of FGF21 to the β-Klotho-FGFR4 complex. In 3T3-L1 cells and white adipose tissue, FGFR1 is by far the most abundant receptor, and it is therefore most likely that FGF21's main functional receptors in this tissue are the β-Klotho/FGFR1c complexes.

The present disclosure provides a human (or humanized) antigen binding protein, such as a monoclonal antibody, that induces FGF21-like signaling, e.g., an agonistic antibody that mimics the function of FGF21. Such an antibody is a molecule with FGF21-like activity and selectivity but with added therapeutically desirable characteristics typical for an antibody such as protein stability, lack of immunogenicity, ease of production and long half-life in vivo.

SUMMARY

An isolated antigen binding protein that induces FGF21-mediated signaling is provided.

Also provided is an isolated antigen binding protein that specifically binds to at least one of: (i) β-Klotho; (ii) FGFR1c, FGFR2c, FGFR3c or FGFR4; and (iii) a complex comprising β-Klotho and one of FGFR1c, FGFR2c, FGFR3c and FGFR4 wherein the antigen binding protein induces FGF21-mediated signaling.

In one embodiment, the provided antigen binding proteins comprise an amino acid sequence selected from the group consisting of: (a) a light chain CDR3 comprising a sequence selected from the group consisting of: (i) a light chain CDR3 sequence that differs by no more than a total of three amino acid additions, substitutions, and/or deletions from a CDR3 sequence selected from the group consisting of the light chain CDR3 sequences of L1-L18, SEQ ID NOs: 180-194; (ii) QVWDX$_1$X$_2$SDHVV (SEQ ID NO: 276); (iii) QQX3GX$_4$X$_5$X$_6$X$_7$T (SEQ ID NO: 283); (iv) LQHNSYPLT (SEQ ID NO: 267); (v) MQSLQTPFT (SEQ ID NO: 268); (vi) QQYNNWPPT (SEQ ID NO: 269); (vii) MQSIQLPRT (SEQ ID NO: 270); (viii) QQANDFPIT (SEQ ID NO: 271); (ix) MQALQTPCS (SEQ ID NO: 272); (b) a heavy chain CDR3 sequence comprising a sequence selected from the group consisting of: (i) a heavy chain CDR3 sequence that differs by no more than a total of four amino acid additions, substitutions, and/or deletions from a CDR3 sequence selected from the group consisting of the heavy chain CDR3 sequences of H1-H18, SEQ ID NOs:145-157; (ii) X$_{34}$X$_{16}$X$_{17}$X$_{18}$GX$_{19}$YYYX$_{20}$GMDV (SEQ ID NO: 322); (iii) SLIVVX$_{21}$VY X$_{22}$LDX$_{23}$ (SEQ ID NO: 326); (iv) IVVVPAAIQSYYYYYGMGV (SEQ ID NO: 311); (v) DPDGDYYYYGMDV (SEQ ID NO: 312); (vi) TYSSGW-YVWDYYGMDV (SEQ ID NO: 313); (vii) DRVL- SYYAMAV (SEQ ID NO: 314); (viii) VRIAGDYY YYYG-MDV (SEQ ID NO: 315); (ix) ENIVVIPAAIFAGWFDP (SEQ ID NO: 316); and (x) DRAAAGLHYYYGMDV (SEQ ID NO: 317); or (c) the light chain CDR3 sequence of (a) and the heavy chain CDR3 sequence of (b); wherein, $X_1$ is G, S or N; $X_2$ is N, S or T; $X_3$ is C, Y or S; $X_4$ is G or S; $X_5$ is A or S; $X_6$ is P or F; $X_7$ is L or absent; $X_{34}$ is I, V or S; $X_{16}$ is L or V; $X_{17}$ is L, T or V; $X_{18}$ is L, V, G or T; $X_{19}$ is A, G or absent; $X_{20}$ is Y, C or D; $X_{21}$ is I or M; $X_{22}$ is A or V; and $X_{23}$ is H or Y; and wherein the antigen binding protein specifically binds (i) β-Klotho; (ii) FGFR1c, FGFR2c, FGFR3c or FGFR4; or (iii) a complex comprising β-Klotho and one of FGFR1c, FGFR2c, FGFR3c, and FGFR4.

In another embodiment the provided antigen binding proteins comprise either: (a) a light chain CDR1 sequence selected from the group consisting of: (i) a light chain CDR1 that differs by no more than three amino acids additions, substitutions, and/or deletions from a CDR1 sequence of L1-L18, SEQ ID NOs:158-170; (ii) RASQ $X_9$ $X_{10}X_{11}X_{12}X_{13}X_{14}$LA (SEQ ID NO: 304); (iii) GGNNIGSX$_{15}$SVH (SEQ ID NO: 307); (iv) RSSQSLLX$_{29}$X$_{30}$NGX$_{31}$X$_{32}$X$_{33}$LD (SEQ ID NO: 310); (v) RASQSVNSNLA (SEQ ID NO: 295); (vi) RASQDIRYDLG (SEQ ID NO: 296); (vii) RASQGISIWLA (SEQ ID NO: 297); and (viii) KSSQSLLQSDGKTYLY (SEQ ID NO: 298); (b) a light chain CDR2 sequence selected from the group consisting of: (i) a light chain CDR2 that differs by no more than two amino acid additions, substitutions, and/or deletions from a CDR2 sequence of L1-L18, SEQ ID NOs: 171-179; (ii) LGSX$_{27}$RAS (SEQ ID NO: 290); (iii) GX$_8$SX$_{28}$RAT (SEQ ID NO: 294); (iv) AASSLQS (SEQ ID NO: 284); (v) GVSTRAT (SEQ ID NO: 285); (vi) DDSDRPS (SEQ ID NO: 286); (vii) EVSNRFS (SEQ ID NO: 287); (c) a heavy chain CDR1 sequence selected from the group consisting of: (i) a heavy chain CDR1 that differs by no more than two amino acid additions, substitutions, and/or deletions from a CDR1 sequence of H1-H18, SEQ ID NOs:121-131; and (ii) NARMGVX$_{39}$ (SEQ ID NO: 352); (iii) $X_{40}$YGIH (SEQ ID NO: 355); (iv) DLSMH (SEQ ID NO: 345); (v) DAWMS (SEQ ID NO: 346); (vi) TYAMS (SEQ ID NO: 347); (vii) SYFWS (SEQ ID NO: 348); (viii) SYYWS (SEQ ID NO: 131); (ix) SGGYNWS (SEQ ID NO: 349); (d) a heavy chain CDR2 selected from the group consisting of: (i) a heavy sequence that differs by no more than three amino acid additions, substitutions, and/or deletions from a CDR2 sequence of H1-H18, SEQ ID NOs:132-144; (ii) HIFSNDE-KSYSTSLKX$_{24}$ (SEQ ID NO: 333); (iii) $X_{251}$SGSGVSTX$_{26}$YADSVKG (SEQ ID NO: 338); (iv) VIWYDGSX$_{35}$KYYX$_{36}$DSVKG (SEQ ID NO: 341); (v) $X_{371}$YX$_{38}$SGSTX$_{41}$YNPSLKS (SEQ ID NO: 344); (vi) GFDPEDGETIYAQKFQG (SEQ ID NO: 327); (vii) RIKSK-TDGGTTDYAAPVKG (SEQ ID NO: 328); (viii) RIYTSG-STNYNPSLKS (SEQ ID NO: 329); (ix) RIKSKDG-GTTDYAAPVKG (SEQ ID NO: 330); (x) RIKSKX$_{42}$DGGTTDYAAPVKG (SEQ ID NO: 483); wherein $X_9$ is N or S; $X_{10}$ is V or F; $X_{11}$ is D or S; $X_{12}$ is G or S; $X_{13}$ is S, N or T; $X_{14}$ is S or Y; $X_{15}$ is E or Q; $X_{29}$ is Y or H; $X_{30}$ is Y or S; $X_{31}$ is F or Y; $X_{32}$ is T or N; $X_{33}$ is Y or F; $X_{27}$ is N or D; $X_8$ is A or T; $X_{28}$ is S or F; $X_{39}$ is S or N; $X_{24}$ is S or N; $X_{25}$ is G or A; $X_{26}$ is H, Y or N; $X_{35}$ is D or I; $X_{36}$ is A or G; $X_{37}$ is N or R; $X_{38}$ is Y or T; $X_{41}$ is Y or N; $X_{42}$ is T or absent; (e) the light chain CDR1 of (a) and the light chain CDR2 of (b); (f) the light chain CDR1 of (a) and the heavy chain CDR1 of (c); (g) the light chain CDR1 of (a) and the heavy chain CDR2 of (d); (h) the light chain CDR1 (b) and the heavy chain CDR1 of (c); (i) the heavy chain CDR1 of (c) and the heavy chain CDR2 of (d); (j) the light chain CDR2 of (b) and the heavy chain CDR2 of (d); (k) the light chain CDR1 of (a), the light chain CDR2 of (b), and the heavy chain CDR1 of (c); (l) the light chain CDR2 of (b), the heavy CDR1 of (c), and the heavy chain CDR2 of (d); (m) the light chain CDR1 of (a), the heavy chain CDR1 of (c), and the heavy chain CDR2 of (d); or (n) the light chain CDR1 of (a), the light chain CDR2 of (b), the heavy chain CDR2 of (c), and the heavy chain CDR2 of (d), wherein said antigen binding protein specifically binds (i) β-Klotho; (ii) FGFR1c, FGFR2c, FGFR3c or FGFR4; or (iii) a complex comprising β-Klotho and one of FGFR1c, FGFR2c, FGFR3c, and FGFR4.

In yet another embodiment the provided antigen binding proteins comprise either: (a) a light chain variable domain comprising; (i) a light chain CDR1 sequence selected from SEQ ID NOs:158-170; (ii) a light chain CDR2 sequence selected from SEQ ID NOs:171-179; (iii) a light chain CDR3 sequence selected from SEQ ID NOs:180-194; and (b) a heavy chain variable domain comprising: (i) a heavy chain CDR1 sequence selected from SEQ ID NOs:121-131; (ii) a heavy chain CDR2 sequence selected from SEQ ID NOs: 132-144; and (iii) a heavy chain CDR3 sequence selected from SEQ ID NOs:145-157; or (c) the light chain variable domain of (a) and the heavy chain variable domain of (b), wherein the antigen binding protein specifically binds (i) β-Klotho; (ii) FGFR1c, FGFR2c, FGFR3c or FGFR4; or (iii) a complex comprising β-Klotho and one of FGFR1c, FGFR2c, FGFR3c, and FGFR4.

In a further embodiment the provided antigen binding proteins comprise either: (a) a light chain variable domain sequence selected from the group consisting of: (i) amino acids having a sequence at least 80% identical to a light chain variable domain sequence selected from $V_L1$-$V_L18$, SEQ ID NOs:48-65; (ii) a sequence of amino acids encoded by a polynucleotide sequence that is at least 80% identical to a polynucleotide sequence encoding the light chain variable domain sequence of $V_L1$-$V_L18$, SEQ ID NOs:48-65; (b) a heavy chain variable domain sequence selected from the group consisting of: (i) a sequence of amino acids that is at least 80% identical to a heavy chain variable domain sequence of $V_H1$-$V_H18$ of SEQ ID NOs:66-84; (ii) a sequence of amino acids encoded by a polynucleotide sequence that is at least 80% identical to a polynucleotide sequence encoding the heavy chain variable domain sequence of $V_H1$-$V_H18$, SEQ ID NOs:66-84; or (c) the light chain variable domain of (a) and the heavy chain variable domain of (b); wherein the antigen binding protein specifically binds (i) β-Klotho; (ii) FGFR1c, FGFR2c, FGFR3c or FGFR4; or (iii) a complex comprising β-Klotho and one of FGFR1c, FGFR2c, FGFR3c, and FGFR4. In particular embodiments the provided antigen binding proteins comprise either: (a) a light chain variable domain sequence selected from the group consisting of: $V_L1$-$V_L18$ of SEQ ID NOs:48-65; (b) a heavy chain variable domain sequence selected from the group consisting of: $V_H1$-$V_H18$ of SEQ ID NOs:66-84; or (c) the light chain variable domain of (a) and the heavy chain variable domain of (b), wherein the antigen binding protein specifically binds (i) β-Klotho; (ii) FGFR1c, FGFR2c, FGFR3c or FGFR4; or (iii) a complex comprising β-Klotho and one of FGFR1c, FGFR2c, FGFR3c, and FGFR4. In other particular embodiments, the provided antigen binding proteins the light chain variable domain and a heavy chain variable domain are selected from the group of combinations consisting of: $V_L1V_H1$, $V_L2V_H2$, $V_L3V_H3$, $V_L3V_H4$, $V_L4V_H5$, $V_L5V_H6$, $V_L6V_H7$, $V_L7V_H8$, $V_L8V_H8$, $V_L9V_H9$, $V_L9V_H10$, $V_L10V_H11$, $V_L11V_H11$, $V_L12V_H12$, $V_L13V_H13$, $V_L14V_H14$, $V_L15V_H15$, $V_L16V_H16$, $V_L17V_H17$, and $V_L18V_H18$, wherein the antigen binding protein specifically binds (i)

β-Klotho; (ii) FGFR1c, FGFR2c, FGFR3c or FGFR4; or (iii) a complex comprising β-Klotho and one of FGFR1c, FGFR2c, FGFR3c, and FGFR4. In still further embodiments the provided antigen binding proteins further comprise: (a) the light chain constant sequence of SEQ ID NO: 10; (b) the light chain constant sequence of SEQ ID NO:11; (c) the heavy chain constant sequence of SEQ ID NO: 9; or (d) the light chain constant sequence of SEQ ID NO: 10 or SEQ ID NO:11 and the heavy chain constant sequence of SEQ ID NO: 9.

The provided antigen binding proteins can take many forms and can be, for example, a human antibody, a humanized antibody, chimeric antibody, a monoclonal antibody, a polyclonal antibody, a recombinant antibody, an antigen-binding antibody fragment, a single chain antibody, a diabody, a triabody, a tetrabody, a Fab fragment, an F(fab')$_2$ fragment, a domain antibody, an IgD antibody, an IgE antibody, an IgM antibody, an IgG1 antibody, an IgG2 antibody, an IgG3 antibody, an IgG4 antibody, or an IgG4 antibody having at least one mutation in the hinge region.

In another embodiment, the provided antigen binding proteins when bound to (i) β-Klotho; (ii) FGFR1c, FGFR2c, FGFR3c or FGFR4; or (iii) a complex comprising β-Klotho and one of FGFR1c, FGFR2c, FGFR3c, and FGFR4: (a) bind to (i) β-Klotho; (ii) FGFR1c, FGFR2c, FGFR3c or FGFR4; or (iii) a complex comprising β-Klotho and one of FGFR1c, FGFR2c, FGFR3c, and FGFR4, with substantially the same Kd as a reference antibody; (b) induce FGF21-like signaling of 10% or greater than the signaling induced by a wild-type FGF21 standard comprising the mature form of SEQ ID NO:2 as measured in an ELK-luciferase reporter assay; (c) exhibit an EC50 of 10 nM or less of FGF21-like signaling in an assay selected from the group consisting of: (i) a FGFR1c/β-Klotho-mediated in vitro recombinant cell-based assay; and (ii) an in vitro human adipocyte functional assay; (d) exhibit an EC50 of less than 10 nM of agonistic activity on FGFR1c in the presence of β-Klotho in an in vitro recombinant FGFR1c receptor mediated reporter assay; and (e) exhibit an EC50 of greater than 1 μM of agonistic activity on FGFR1c in the absence of β-Klotho in an in vitro recombinant FGFR1c receptor mediated reporter assay; or (f) competes for binding with a reference antibody to (i) β-Klotho; (ii) FGFR1c, FGFR2c, FGFR3c or FGFR4; or (iii) a complex comprising β-Klotho and one of FGFR1c, FGFR2c, FGFR3c, and FGFR4, wherein the reference antibody comprises a combination of light chain and heavy chain variable domain sequences selected from the group consisting of $V_L1V_H1$, $V_L2V_H2$, $V_L3V_H3$, $V_L3V_H4$, $V_L4V_H5$, $V_L5V_H6$, $V_L6V_H7$, $V_L7V_H8$, $V_L8V_H8$, $V_L9V_H9$, $V_L9V_H10$, $V_L10V_H11$, $V_L11V_H11$, $V_L12V_H12$, $V_L13V_H13$, $V_L14V_H14$, $V_L15V_H15$, $V_L16V_H16$, $V_L17V_H17$, and $V_L18V_H18$. In other embodiments the provided antigen binding proteins can when bound to (i) β-Klotho; (ii) FGFR1c, FGFR2c, FGFR3c or FGFR4; or (iii) a complex comprising β-Klotho and one of FGFR1c, FGFR2c, FGFR3c, and FGFR4: (a) lower blood glucose in an animal model; (b) lower serum lipid levels in an animal model; (c) lower insulin levels in an animal model; or (d) two or more of (a) and (b) and (c).

In specific embodiments the provided antigen binding proteins comprise: (a) a heavy chain comprising one of SEQ ID NOs:31, 32, 390-401, 404-405; (b) a light chain comprising one of SEQ ID NO:13, 14, 385-389, 402-403; or (c) a combination comprising a heavy chain of (a) and a light chain of (b).

Also provided are antigen binding proteins that are capable of binding wild type human β-Klotho (SEQ ID NO:7) but which doesn't bind to a chimeric form of β-Klotho wherein the chimeric form of β-Klotho comprises a human β-Klotho framework wherein murine β-Klotho sequences replace the wild type human residues at least one of (a) positions 1-80; (b) positions 303-522; (c) positions 852-1044; and (d) combinations thereof.

In another aspect, the present disclosure provides antigen binding proteins that are capable of binding wild type human β-Klotho (SEQ ID NO:7) at least one of (a) positions 1-80; (b) positions 303-522; (c) positions 852-1044; and (d) combinations thereof.

In still another aspect, the present disclosure provides antigen binding proteins that are capable of competing with an antigen binding protein of claim 8 or 13 for binding to human wild type β-Klotho residues at least one of (a) positions 1-80; (b) positions 303-522; (c) positions 852-1044; and (d) combinations thereof.

Also provided is a pharmaceutical composition comprising one or more antigen binding proteins provided herein, in admixture with a pharmaceutically acceptable carrier thereof.

In a further aspect, also provided are isolated nucleic acid molecules that encode the antigen binding proteins disclosed herein. In some instances, the isolated nucleic acid molecules are operably-linked to a control sequence. In embodiments, such nucleic acids comprise a polynucleotide sequence encoding the light chain variable domain, the heavy chain variable domain, or both, of an antigen binding protein provided herein. In particular embodiments the nucleic acids comprise (a) $V_L1$-$V_L18$ (SEQ ID NOs:48-65); (b) $V_H1$-$V_H18$ (SEQ ID NOs:66-84); or (c) one or more sequences of (a) and one or more sequences of (b).

In another aspect, also provided are expression vectors and host cells transformed or transfected with the expression vectors that comprise the aforementioned isolated nucleic acid molecules that encode the antigen binding proteins disclosed herein.

In another aspect, also provided are methods of preparing antigen binding proteins that specifically or selectively bind (i) β-Klotho; (ii) FGFR1c, FGFR2c, FGFR3c or FGFR4; or (iii) a complex comprising β-Klotho and one of FGFR1c, FGFR2c, FGFR3c, and FGFR4 and comprises the step of preparing the antigen binding protein from a host cell that secretes the antigen binding protein.

Other embodiments provide a method of preventing or treating a condition in a subject in need of such treatment comprising administering a therapeutically effective amount of a pharmaceutical composition provided herein to a subject, wherein the condition is treatable by lowering blood glucose, insulin or serum lipid levels. In embodiments, the condition is type 2 diabetes, obesity, dyslipidemia, NASH, cardiovascular disease or metabolic syndrome.

These and other aspects are described in greater detail herein. Each of the aspects provided can encompass various embodiments provided herein. It is therefore anticipated that each of the embodiments involving one element or combinations of elements can be included in each aspect described, and all such combinations of the above aspects and embodiments are expressly considered. Other features, objects, and advantages of the disclosed antigen binding proteins and associated methods and compositions are apparent in the detailed description that follows.

BRIEF DESCRIPTION OF THE DRAWINGS

FIG. 1A-1B is an alignment showing the sequence homology between human FGFR1c (GenBank™ Accession No P11362; SEQ ID NO: 356) and murine FGFR1c (GenBank™ Accession No NP_034336; SEQ ID NO: 357); various features are highlighted, including the signal peptide, transmembrane sequence, heparin binding region, and a consensus sequence (SEQ ID NO: 358) is provided.

FIG. 2a-2c is an alignment showing the sequence homology between human β-Klotho (GenBank™ Accession No NP_783864; SEQ ID NO: 359) and murine β-Klotho (GenBank™ Accession No NP_112457; SEQ ID NO: 360); various features are highlighted, including the transmembrane sequence and two glycosyl hydrolase domains, and a consensus sequence (SEQ ID NO: 361) is provided.

FIG. 4 is a sequence (SEQ ID NO: 362) showing an Fc fusion protein that was used as an immunogen to generate antigen binding proteins; the immunogen comprises the extracellular domain (ECD) of human FGFR1c fused to an IgG1 Fc via a Gly$_5$ linker (SEQ ID NO: 379); the FGFR1c component is in capitals, the linker is italic and underlined and the Fc is in lower case letters.

FIG. 5 is a sequence (SEQ ID NO: 363) showing an Fc fusion protein that was used as an immunogen to generate antigen binding proteins; the immunogen comprises the extracellular domain (ECD) of human β-Klotho fused to an IgG1 Fc via a Gly$_5$ linker (SEQ ID NO: 379); the β-Klotho component is in capitals, the linker is italic and underlined and the Fc is in lower case letters.

FIGS. 8A-8C are a series of plots generated from an ERK 1/2 phosphorylation assay as described herein, demonstrating the ability of some of the antigen binding proteins to induce FGF21-like signaling in rat L6 cells. The X-axis is the concentrations of the antigen binding proteins and the Y-axis is the percentage of phosphorylated ERK 1/2 of total ERK 1/2.

FIGS. 9A-9D are a series of plots generated from an ERK 1/2 phosphorylation assay as described herein, demonstrating that antigen binding protein-mediated FGF21-like signaling in L6 cells is FGFR1c/β-Klotho specific.

FIGS. 10A-10D are a series of plots generated from an ERK phosphorylation assay as described herein, demonstrating that some antigen binding proteins are able to induce FGF21-like signaling in human adipocyte cells.

FIGS. 11B-11F are a series of binding sensorgrams (response units vs time) demonstrating a third binding site on human β-Klotho that was identified for Group C antigen binding proteins represented by 39F7.

FIG. 11G is a table summarizing epitope binning.

FIG. 12 is a series of binding sensorgrams (response units vs time) demonstrating that some of the antigen binding proteins (12E4, 24H11, 17C3, 18B11) that induce FGF21-mediated signaling interfere with β-Klotho binding to FGF21, while other antigen binding proteins (21H2, 17D8, 18G1) do not.

FIGS. 13A-13F are an alignment of the variable regions of some of the antigen binding proteins that were generated: the framework and CDR regions are identified. FIG. 13 discloses SEQ ID NOS: 364, 59, 365, 60, 366, 61, 367, 62, 368, 57, 369, 55, 51-52, 56. 56, 53-54, 63-65, 370, 58, 371, 50, 50, 49, 48, 372 78, 373, 66-69, 79, 374, 76, 81, 375, 70, 73, 73, 71-72, 376, 83, 82, 84, 377, 80, 378, 75 and 74, respectively, in order of appearance.

FIG. 14 is a diagram graphically depicting the study design for a 68 days study performed in obese cynomolgus monkeys.

FIGS. 25A-25B are a plot showing the effects of vehicle and 16H7 on fed plasma glucose levels of the obese cynomolgus monkeys studied.

FIG. 30 is a schematic depicting the human-mouse β-Klotho chimeras that were constructed and also includes qualitative binding data for FGF21, 16H7, 37D3 and 39F7.

FIG. 31A-C is a series of plots depicting binding data for eight of the 16H7 and 22H5 variants that were constructed, as well as for 22H5 and 16H7.

DETAILED DESCRIPTION

Figure 3A:
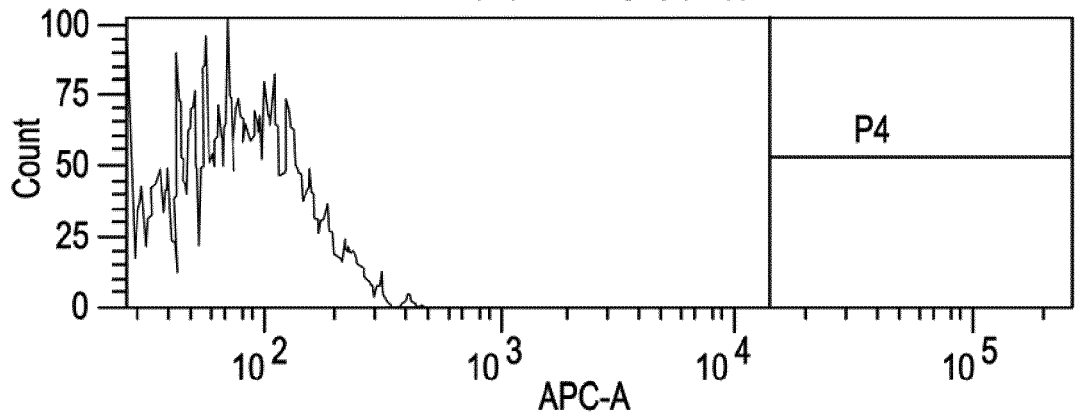
FIGS. 3A-3F are a flow cytometry profile of cells stained with FGF21-Alexa 647 that were used as an immunogen to generate antigen binding proteins; the figure shows the expression level of an FGF21R (a complex comprising FGFR1c and β-Klotho) and binding to FGF21.
Figure 3B:
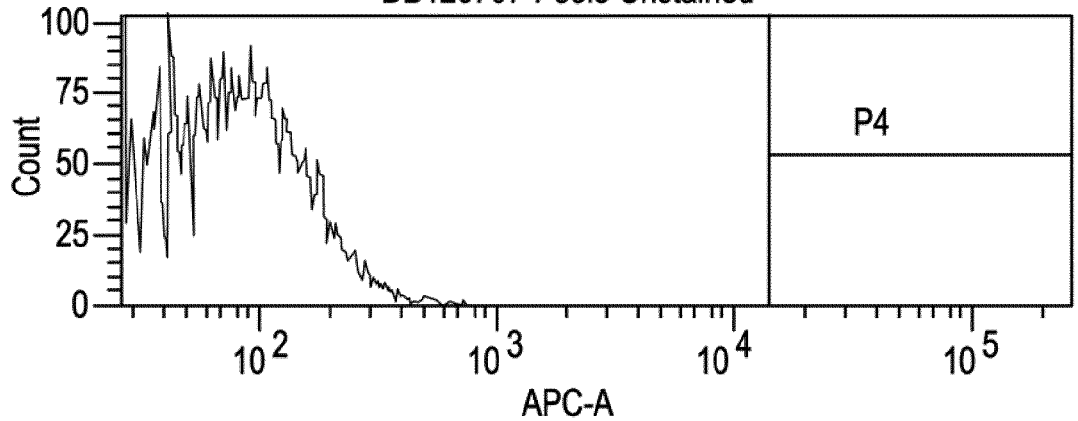
Figure 3C:
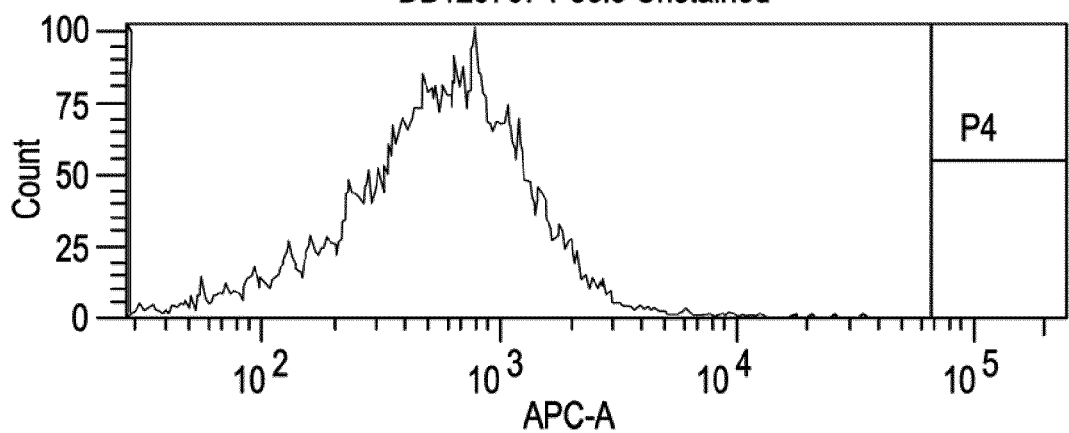
Figure 3D:
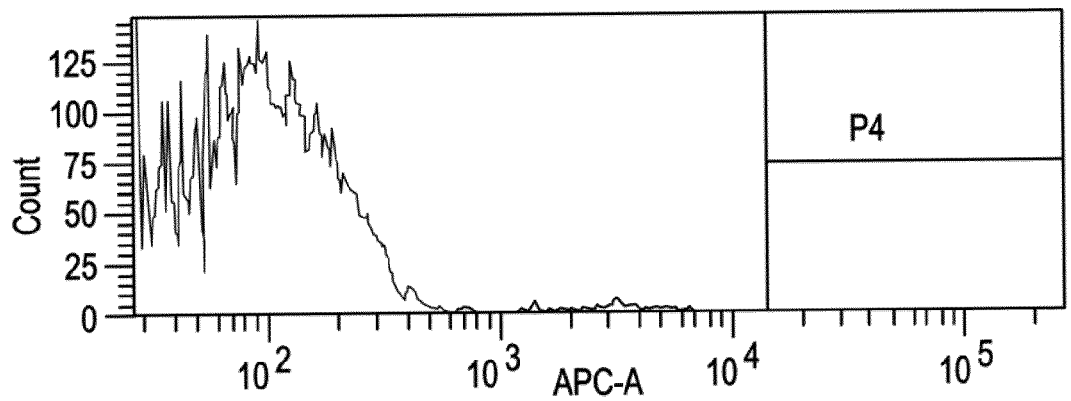
Figure 3E:
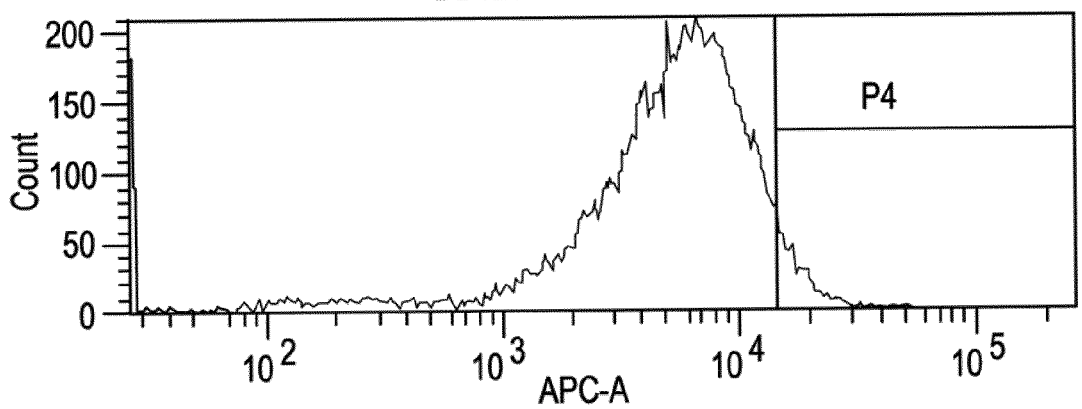
Figure 3F:
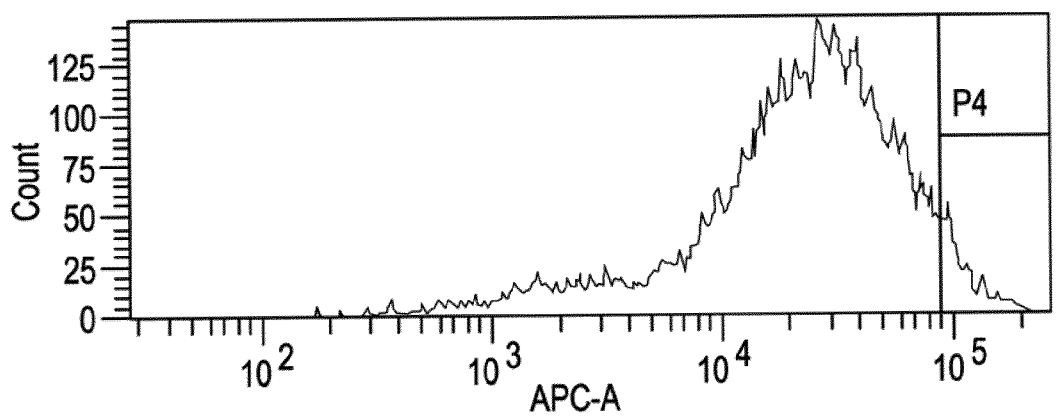

The section headings used herein are for organizational purposes only and are not to be construed as limiting the subject matter described.

Unless otherwise defined herein, scientific and technical terms used in connection with the present application shall have the meanings that are commonly understood by those of ordinary skill in the art. Further, unless otherwise required by context, singular terms shall include pluralities and plural terms shall include the singular.

Generally, nomenclatures used in connection with, and techniques of, cell and tissue culture, molecular biology, immunology, microbiology, genetics and protein and nucleic acid chemistry and hybridization described herein are those well known and commonly used in the art. The methods and techniques of the present application are generally performed according to conventional methods well known in the art and as described in various general and more specific references that are cited and discussed throughout the present specification unless otherwise indicated. See, e.g., Sambrook et al., Molecular Cloning: A Laboratory Manual, 3rd ed., Cold Spring Harbor Laboratory Press, Cold Spring Harbor, N.Y. (2001), Ausubel et al., Current Protocols in Molecular Biology, Greene Publishing Associates (1992), and Harlow and Lane Antibodies: A Laboratory Manual Cold Spring Harbor Laboratory Press, Cold Spring Harbor, N.Y. (1990), which are incorporated herein by reference. Enzymatic reactions and purification techniques are performed according to manufacturer's specifications, as commonly accomplished in the art or as described herein. The terminology used in connection with, and the laboratory procedures and techniques of, analytical chemistry, synthetic organic chemistry, and medicinal and pharmaceutical chemistry described herein are those well known and commonly used in the art. Standard techniques can be used for chemical syntheses, chemical analyses, pharmaceutical preparation, formulation, and delivery, and treatment of patients.

It should be understood that the instant disclosure is not limited to the particular methodology, protocols, and reagents, etc., described herein and as such can vary. The terminology used herein is for the purpose of describing particular embodiments only, and is not intended to limit the scope of the present disclosure.

Other than in the operating examples, or where otherwise indicated, all numbers expressing quantities of ingredients or reaction conditions used herein should be understood as modified in all instances by the term "about." The term "about" when used in connection with percentages can mean±5%, e.g., 1%, 2%, 3%, or 4%.

I. Definitions

As used herein, the terms "a" and "an" mean "one or more" unless specifically stated otherwise.

An "antigen binding protein" is a protein comprising a portion that binds to an antigen or target and, optionally, a scaffold or framework portion that allows the antigen binding portion to adopt a conformation that promotes binding of the antigen binding protein to the antigen. Examples of antigen binding proteins include a human antibody, a humanized antibody; a chimeric antibody; a recombinant antibody; a single chain antibody; a diabody; a triabody; a tetrabody; a Fab fragment; a F(ab')$_2$ fragment; an IgD antibody; an IgE antibody; an IgM antibody; an IgG1 antibody; an IgG2 antibody; an IgG3 antibody; or an IgG4 antibody, and fragments thereof. The antigen binding protein can comprise, for example, an alternative protein scaffold or artificial scaffold with grafted CDRs or CDR derivatives. Such scaffolds include, but are not limited to, antibody-derived scaffolds comprising mutations introduced to, for example, stabilize the three-dimensional structure of the antigen binding protein as well as wholly synthetic scaffolds comprising, for example, a biocompatible polymer. See, e.g., Korndorfer et al., 2003, *Proteins: Structure, Function, and Bioinformatics*, 53(1):121-129 (2003); Roque et al., *Biotechnol. Prog.* 20:639-654 (2004). In addition, peptide antibody mimetics ("PAMs") can be used, as well as scaffolds based on antibody mimetics utilizing fibronectin components as a scaffold.

An antigen binding protein can have, for example, the structure of a naturally occurring immunoglobulin. An "immunoglobulin" is a tetrameric molecule. In a naturally occurring immunoglobulin, each tetramer is composed of two identical pairs of polypeptide chains, each pair having one "light" (about 25 kDa) and one "heavy" chain (about 50-70 kDa). The amino-terminal portion of each chain includes a variable region of about 100 to 110 or more amino acids primarily responsible for antigen recognition. The carboxy-terminal portion of each chain defines a constant region primarily responsible for effector function. Human light chains are classified as kappa and lambda light chains. Heavy chains are classified as mu, delta, gamma, alpha, or epsilon, and define the antibody's isotype as IgM, IgD, IgG, IgA, and IgE, respectively. Within light and heavy chains, the variable and constant regions are joined by a "J" region of about 12 or more amino acids, with the heavy chain also including a "D" region of about 10 more amino acids. See generally, Fundamental Immunology Ch. 7 (Paul, W., ed., 2$^{nd}$ ed. Raven Press, N.Y. (1989)) (incorporated by reference in its entirety for all purposes). The variable regions of each light/heavy chain pair form the antibody binding site such that an intact immunoglobulin has two binding sites.

Naturally occurring immunoglobulin chains exhibit the same general structure of relatively conserved framework regions (FR) joined by three hypervariable regions, also called complementarity determining regions or CDRs. From N-terminus to C-terminus, both light and heavy chains comprise the domains FR1, CDR1, FR2, CDR2, FR3, CDR3 and FR4. The assignment of amino acids to each domain can be done in accordance with the definitions of Kabat et al. in Sequences of Proteins of Immunological Interest, 5$^{th}$ Ed., US Dept. of Health and Human Services, PHS, NIH, NIH Publication no. 91-3242, 1991. As desired, the CDRs can also be redefined according an alternative nomenclature scheme, such as that of Chothia (see Chothia & Lesk, 1987, *J. Mol. Biol.* 196:901-917; Chothia et al., 1989, *Nature* 342:878-883 or Honegger & Pluckthun, 2001, *J. Mol. Biol.* 309:657-670).

In the context of the instant disclosure an antigen binding protein is said to "specifically bind" or "selectively bind" its target antigen when the dissociation constant ($K_D$) is $\leq 10^{-8}$ M. The antibody specifically binds antigen with "high affinity" when the $K_D$ is $\leq 5 \times 10^{-9}$ M, and with "very high affinity"

when the $K_D$ is $\leq 5 \times 10^{-10}$ M. In one embodiment, the antibodies will bind to FGFR1c, β-Klotho, both FGFR1c and β-Klotho or a complex comprising FGFR1c and β-Klotho, including human FGFR1c, human β-Klotho or both human FGFR1c and human β-Klotho, with a $K_D$ of between about $10^{-7}$ M and $10^{-12}$ M, and in yet another embodiment the antibodies will bind with a $K_D \leq 5 \times 10^{-9}$.

An "antibody" refers to an intact immunoglobulin or to an antigen binding portion thereof that competes with the intact antibody for specific binding, unless otherwise specified. Antigen binding portions can be produced by recombinant DNA techniques or by enzymatic or chemical cleavage of intact antibodies. Antigen binding portions include, inter alia, Fab, Fab', F(ab')$_2$, Fv, domain antibodies (dAbs), fragments including complementarity determining regions (CDRs), single-chain antibodies (scFv), chimeric antibodies, diabodies, triabodies, tetrabodies, and polypeptides that contain at least a portion of an immunoglobulin that is sufficient to confer specific antigen binding to the polypeptide.

A Fab fragment is a monovalent fragment having the $V_L$, $V_H$, $C_L$ and $C_H 1$ domains; a F(ab')$_2$ fragment is a bivalent fragment having two Fab fragments linked by a disulfide bridge at the hinge region; a Fd fragment has the $V_H$ and $C_H 1$ domains; an Fv fragment has the $V_L$ and $V_H$ domains of a single arm of an antibody; and a dAb fragment has a $V_H$ domain, a $V_L$ domain, or an antigen-binding fragment of a $V_H$ or $V_L$ domain (U.S. Pat. Nos. 6,846,634, 6,696,245, U.S. application Pub. Ser. Nos. 05/0202512, 04/0202995, 04/0038291, 04/0009507, 03/0039958, Ward et al., Nature 341:544-546 (1989)).

A single-chain antibody (scFv) is an antibody in which a $V_L$ and a $V_H$ region are joined via a linker (e.g., a synthetic sequence of amino acid residues) to form a continuous protein chain wherein the linker is long enough to allow the protein chain to fold back on itself and form a monovalent antigen binding site (see, e.g., Bird et al., *Science* 242:423-26 (1988) and Huston et al., 1988, *Proc. Natl. Acad. Sci. USA* 85:5879-83 (1988)). Diabodies are bivalent antibodies comprising two polypeptide chains, wherein each polypeptide chain comprises $V_H$ and $V_L$ domains joined by a linker that is too short to allow for pairing between two domains on the same chain, thus allowing each domain to pair with a complementary domain on another polypeptide chain (see, e.g., Holliger et al., 1993, *Proc. Natl. Acad. Sci. USA* 90:6444-48 (1993), and Poljak et al., *Structure* 2:1121-23 (1994)). If the two polypeptide chains of a diabody are identical, then a diabody resulting from their pairing will have two identical antigen binding sites. Polypeptide chains having different sequences can be used to make a diabody with two different antigen binding sites. Similarly, tribodies and tetrabodies are antibodies comprising three and four polypeptide chains, respectively, and forming three and four antigen binding sites, respectively, which can be the same or different.

Complementarity determining regions (CDRs) and framework regions (FR) of a given antibody can be identified using the system described by Kabat et al. in Sequences of Proteins of Immunological Interest, 5th Ed., US Dept. of Health and Human Services, PHS, NIH, NIH Publication no. 91-3242, 1991 As desired, the CDRs can also be redefined according an alternative nomenclature scheme, such as that of Chothia (see Chothia & Lesk, 1987, *J. Mol. Biol.* 196:901-917; Chothia et al., 1989, *Nature* 342:878-883 or Honegger & Pluckthun, 2001, *J. Mol. Biol.* 309:657-670. One or more CDRs can be incorporated into a molecule either covalently or noncovalently to make it an antigen binding protein. An antigen binding protein can incorporate the CDR(s) as part of a larger polypeptide chain, can covalently link the CDR(s) to another polypeptide chain, or can incorporate the CDR(s) noncovalently. The CDRs permit the antigen binding protein to specifically bind to a particular antigen of interest.

An antigen binding protein can have one or more binding sites. If there is more than one binding site, the binding sites can be identical to one another or can be different. For example, a naturally occurring human immunoglobulin typically has two identical binding sites, while a "bispecific" or "bifunctional" antibody has two different binding sites.

The term "human antibody" includes all antibodies that have one or more variable and constant regions derived from human immunoglobulin sequences. In one embodiment, all of the variable and constant domains are derived from human immunoglobulin sequences (a fully human antibody). These antibodies can be prepared in a variety of ways, examples of which are described below, including through the immunization with an antigen of interest of a mouse that is genetically modified to express antibodies derived from human heavy and/or light chain-encoding genes, such as a mouse derived from a Xenomouse®, UltiMab™, or Velocimmune® system. Phage-based approaches can also be employed.

A humanized antibody has a sequence that differs from the sequence of an antibody derived from a non-human species by one or more amino acid substitutions, deletions, and/or additions, such that the humanized antibody is less likely to induce an immune response, and/or induces a less severe immune response, as compared to the non-human species antibody, when it is administered to a human subject. In one embodiment, certain amino acids in the framework and constant domains of the heavy and/or light chains of the non-human species antibody are mutated to produce the humanized antibody. In another embodiment, the constant domain(s) from a human antibody are fused to the variable domain(s) of a non-human species. In another embodiment, one or more amino acid residues in one or more CDR sequences of a non-human antibody are changed to reduce the likely immunogenicity of the non-human antibody when it is administered to a human subject, wherein the changed amino acid residues either are not critical for immunospecific binding of the antibody to its antigen, or the changes to the amino acid sequence that are made are conservative changes, such that the binding of the humanized antibody to the antigen is not significantly worse than the binding of the non-human antibody to the antigen. Examples of how to make humanized antibodies can be found in U.S. Pat. Nos. 6,054,297, 5,886,152 and 5,877,293.

The term "chimeric antibody" refers to an antibody that contains one or more regions from one antibody and one or more regions from one or more other antibodies. In one embodiment, one or more of the CDRs are derived from a human antibody that binds (i) β-Klotho; (ii) FGFR1c, FGFR2c, FGFR3c or FGFR4; or (iii) a complex comprising β-Klotho and one of FGFR1c, FGFR2c, FGFR3c, and FGFR4. In another embodiment, all of the CDRs are derived from a human antibody that binds (i) β-Klotho; (ii) FGFR1c, FGFR2c, FGFR3c or FGFR4; or (iii) a complex comprising β-Klotho and one of FGFR1c, FGFR2c, FGFR3c, and FGFR4. In another embodiment, the CDRs from more than one human antibody that binds (i) β-Klotho; (ii) FGFR1c, FGFR2c, FGFR3c or FGFR4; or (iii) a complex comprising β-Klotho and one of FGFR1c, FGFR2c, FGFR3c, and FGFR4 are mixed and matched in a chimeric antibody. For instance, a chimeric antibody can comprise a CDR1 from the light chain of a first human antibody that binds (i) β-Klotho; (ii) FGFR1c, FGFR2c, FGFR3c or FGFR4; or (iii) a complex comprising β-Klotho and one of FGFR1c, FGFR2c, FGFR3c, and FGFR4, a CDR2 and a CDR3 from the light chain of a second human antibody that binds (i) β-Klotho; (ii) FGFR1c, FGFR2c, FGFR3c or FGFR4; or (iii) a complex comprising β-Klotho and one of FGFR1c, FGFR2c, FGFR3c, and FGFR4, and the CDRs from the heavy chain from a third antibody that binds (i) β-Klotho; (ii) FGFR1c, FGFR2c, FGFR3c or FGFR4; or (iii) a complex comprising β-Klotho and one of FGFR1c, FGFR2c, FGFR3c, and FGFR4. Further, the framework regions can be derived from one of the same antibodies that bind (i) β-Klotho; (ii) FGFR1c, FGFR2c, FGFR3c or FGFR4; or (iii) a complex comprising β-Klotho and one of FGFR1c, FGFR2c, FGFR3c, and FGFR4, from one or more different antibodies, such as a human antibody, or from a humanized antibody. In one example of a chimeric antibody, a portion of the heavy and/or light chain is identical with, homologous to, or derived from an antibody from a particular species or belonging to a particular antibody class or subclass, while the remainder of the chain(s) is/are identical with, homologous to, or derived from an antibody or antibodies from another species or belonging to another antibody class or subclass. Also included are fragments of such antibodies that exhibit the desired biological activity (e.g., the ability to specifically bind (i) β-Klotho; (ii) FGFR1c, FGFR2c, FGFR3c or FGFR4; or (iii) a complex comprising β-Klotho and one of FGFR1c, FGFR2c, FGFR3c, and FGFR4).

The term "light chain" includes a full-length light chain and fragments thereof having sufficient variable region sequence to confer binding specificity. A full-length light chain includes a variable region domain, $V_L$, and a constant region domain, $C_L$. The variable region domain of the light chain is at the amino-terminus of the polypeptide. Light chains include kappa ("κ") chains and lambda ("λ") chains.

The term "heavy chain" includes a full-length heavy chain and fragments thereof having sufficient variable region sequence to confer binding specificity. A full-length heavy chain includes a variable region domain, $V_H$, and three constant region domains, $C_H1$, $C_H2$, and $C_H3$. The $V_H$ domain is at the amino-terminus of the polypeptide, and the $C_H$ domains are at the carboxyl-terminus, with the $C_H3$ being closest to the carboxy-terminus of the polypeptide. Heavy chains can be of any isotype, including IgG (including IgG1, IgG2, IgG3 and IgG4 subtypes), IgA (including IgA1 and IgA2 subtypes), IgM and IgE.

The term "immunologically functional fragment" (or simply "fragment") of an antigen binding protein, e.g., an antibody or immunoglobulin chain (heavy or light chain), as used herein, is an antigen binding protein comprising a portion (regardless of how that portion is obtained or synthesized) of an antibody that lacks at least some of the amino acids present in a full-length chain but which is capable of specifically binding to an antigen. Such fragments are biologically active in that they bind specifically to the target antigen and can compete with other antigen binding proteins, including intact antibodies, for specific binding to a given epitope. In one aspect, such a fragment will retain at least one CDR present in the full-length light or heavy chain, and in some embodiments will comprise a single heavy chain and/or light chain or portion thereof. These biologically active fragments can be produced by recombinant DNA techniques, or can be produced by enzymatic or chemical cleavage of antigen binding proteins, including intact antibodies. Immunologically functional immunoglobulin fragments include, but are not limited to, Fab, Fab', F(ab')$_2$, Fv, domain antibodies and single-chain antibodies, and can be derived from any mammalian source, including but not limited to human, mouse, rat, camelid or rabbit. It is contemplated further that a functional portion of the antigen binding proteins disclosed herein, for example, one or more CDRs, could be covalently bound to a second protein or to a small molecule to create a therapeutic agent directed to a particular target in the body, possessing bifunctional therapeutic properties, or having a prolonged serum half-life.

An "Fc" region contains two heavy chain fragments comprising the $C_H2$ and $C_H3$ domains of an antibody. The two heavy chain fragments are held together by two or more disulfide bonds and by hydrophobic interactions of the $C_H3$ domains.

An "Fab' fragment" contains one light chain and a portion of one heavy chain that contains the $V_H$ domain and the $C_H1$ domain and also the region between the $C_H1$ and $C_H2$ domains, such that an interchain disulfide bond can be formed between the two heavy chains of two Fab' fragments to form an F(ab')$_2$ molecule.

An "F(ab')$_2$ fragment" contains two light chains and two heavy chains containing a portion of the constant region between the $C_H1$ and $C_H2$ domains, such that an interchain disulfide bond is formed between the two heavy chains. A F(ab')$_2$ fragment thus is composed of two Fab' fragments that are held together by a disulfide bond between the two heavy chains.

The "Fv region" comprises the variable regions from both the heavy and light chains, but lacks the constant regions.

A "domain antibody" is an immunologically functional immunoglobulin fragment containing only the variable region of a heavy chain or the variable region of a light chain. In some instances, two or more $V_H$ regions are covalently joined with a peptide linker to create a bivalent domain antibody. The two $V_H$ regions of a bivalent domain antibody can target the same or different antigens.

A "hemibody" is an immunologically functional immunoglobulin construct comprising a complete heavy chain, a complete light chain and a second heavy chain Fc region paired with the Fc region of the complete heavy chain. A linker can, but need not, be employed to join the heavy chain Fc region and the second heavy chain Fc region. In particular embodiments a hemibody is a monovalent form of an antigen binding protein disclosed herein. In other embodiments, pairs of charged residues can be employed to associate one Fc region with the second Fc region. The second heavy chain Fc region can comprise, for example, SEQ ID NO:441 and can be joined to the light chain via a linker (e.g., SEQ ID NO:440) An exemplary hemibody heavy chain comprises the sequence SEQ ID NO:453.

A "bivalent antigen binding protein" or "bivalent antibody" comprises two antigen binding sites. In some instances, the two binding sites have the same antigen specificities. Bivalent antigen binding proteins and bivalent antibodies can be bispecific, as described herein.

A multispecific antigen binding protein" or "multispecific antibody" is one that targets more than one antigen or epitope.

A "bispecific," "dual-specific" or "bifunctional" antigen binding protein or antibody is a hybrid antigen binding protein or antibody, respectively, having two different antigen binding sites. Bispecific antigen binding proteins and antibodies are a species of multispecific antigen binding protein or multispecific antibody and can be produced by a variety of methods including, but not limited to, fusion of hybridomas or linking of Fab' fragments. See, e.g., Songsivilai and Lachmann, 1990, *Clin. Exp. Immunol.* 79:315-321; Kostelny et al., 1992, *J. Immunol.* 148:1547-1553. The two binding sites of a bispecific antigen binding protein or antibody will bind to two different epitopes, which can reside on the same or different protein targets.

The terms "FGF21-like signaling" and "induces FGF21-like signaling," when applied to an antigen binding protein of the present disclosure, means that the antigen binding protein mimics, or modulates, an in vivo biological effect induced by the binding of (i) β-Klotho; (ii) FGFR1c, FGFR2c, FGFR3c or FGFR4; or (iii) a complex comprising β-Klotho and one of FGFR1c, FGFR2c, FGFR3c, and FGFR4 and induces a biological response that otherwise would result from FGF21 binding to (i) β-Klotho; (ii) FGFR1c, FGFR2c, FGFR3c or FGFR4; or (iii) a complex comprising β-Klotho and one of FGFR1c, FGFR2c, FGFR3c, and FGFR4 in vivo. In assessing the binding and specificity of an antigen binding protein, e.g., an antibody or immunologically functional fragment thereof, an antibody or fragment is deemed to induce a biological response when the response is equal to or greater than 5%, and preferably equal to or greater than 10%, 15%, 20%, 25%, 30%, 35%, 40%, 45%, 50%, 55%, 60%, 65%, 70%, 75%, 80%, 85%, 90% or 95%, of the activity of a wild type FGF21 standard comprising the mature form of SEQ ID NO:2 (i.e., the mature form of the human FGF21 sequence) and has the following properties: exhibiting an efficacy level of equal to or more than 5% of an FGF21 standard, with an EC50 of equal to or less than 100 nM, e.g., 90 nM, 80 nM, 70 nM, 60 nM, 50 nM, 40 nM, 30 nM, 20 nM or 10 nM in (1) the recombinant FGF21 receptor mediated luciferase-reporter cell assay of Example 5; (2) ERK-phosphorylation in the recombinant FGF21 receptor mediated cell assay of Example 5; and (3) ERK-phosphorylation in human adipocytes as described in Example 7. The "potency" of an antigen binding protein is defined as exhibiting an EC50 of equal to or less than 100 nM, e.g., 90 nM, 80 nM, 70 nM, 60 nM, 50 nM, 40 nM, 30 nM, 20 nM, 10 nM and preferably less than 10 nM of the antigen binding protein in the following assays: (1) the recombinant FGF21 receptor mediated luciferase-reporter cell assay of Example 5; (2) the ERK-phosphorylation in the recombinant FGF21 receptor mediated cell assay of Example 5; and (3) ERK-phosphorylation in human adipocytes as described in Example 7.

It is noted that not all of the antigen binding proteins of the present disclosure induce FGF21-mediated signaling, nor is this property desirable in all circumstances. Nevertheless, antigen binding proteins that do not induce FGF21-mediated signaling form aspects of the present disclosure and may be useful as diagnostic reagents or other applications.

As used herein, the term "FGF21R" means a multimeric receptor complex that FGF21 is known or suspected to form in vivo. In various embodiments, FGF21R comprises (i) an FGFR, e.g., FGFR1c, FGFR2c, FGFR3c or FGFR4, and (ii) β-Klotho.

The term "polynucleotide" or "nucleic acid" includes both single-stranded and double-stranded nucleotide polymers. The nucleotides comprising the polynucleotide can be ribonucleotides or deoxyribonucleotides or a modified form of either type of nucleotide. Said modifications include base modifications such as bromouridine and inosine derivatives, ribose modifications such as 2',3'-dideoxyribose, and internucleotide linkage modifications such as phosphorothioate, phosphorodithioate, phosphoroselenoate, phosphorodiselenoate, phosphoroanilothioate, phoshoraniladate and phosphoroamidate.

The term "oligonucleotide" means a polynucleotide comprising 200 or fewer nucleotides. In some embodiments, oligonucleotides are 10 to 60 bases in length. In other embodiments, oligonucleotides are 12, 13, 14, 15, 16, 17, 18, 19, or 20 to 40 nucleotides in length. Oligonucleotides can be single stranded or double stranded, e.g., for use in the construction of a mutant gene. Oligonucleotides can be sense or antisense oligonucleotides. An oligonucleotide can include a label, including a radiolabel, a fluorescent label, a hapten or an antigenic label, for detection assays. Oligonucleotides can be used, for example, as PCR primers, cloning primers or hybridization probes.

An "isolated nucleic acid molecule" means a DNA or RNA of genomic, mRNA, cDNA, or synthetic origin or some combination thereof which is not associated with all or a portion of a polynucleotide in which the isolated polynucleotide is found in nature, or is linked to a polynucleotide to which it is not linked in nature. For purposes of this disclosure, it is understood that "a nucleic acid molecule comprising" a particular nucleotide sequence does not encompass intact chromosomes. Isolated nucleic acid molecules "comprising" specified nucleic acid sequences can include, in addition to the specified sequences, coding sequences for up to ten or even up to twenty other proteins or portions thereof, or can include operably linked regulatory sequences that control expression of the coding region of the recited nucleic acid sequences, and/or can include vector sequences.

Unless specified otherwise, the left-hand end of any single-stranded polynucleotide sequence discussed herein is the 5' end; the left-hand direction of double-stranded polynucleotide sequences is referred to as the 5' direction. The direction of 5' to 3' addition of nascent RNA transcripts is referred to as the transcription direction; sequence regions on the DNA strand having the same sequence as the RNA transcript that are 5' to the 5' end of the RNA transcript are referred to as "upstream sequences;" sequence regions on the DNA strand having the same sequence as the RNA transcript that are 3' to the 3' end of the RNA transcript are referred to as "downstream sequences."

The term "control sequence" refers to a polynucleotide sequence that can affect the expression and processing of coding sequences to which it is ligated. The nature of such control sequences can depend upon the host organism. In particular embodiments, control sequences for prokaryotes can include a promoter, a ribosomal binding site, and a transcription termination sequence. For example, control sequences for eukaryotes can include promoters comprising one or a plurality of recognition sites for transcription factors, transcription enhancer sequences, and transcription termination sequence. "Control sequences" can include leader sequences and/or fusion partner sequences.

The term "vector" means any molecule or entity (e.g., nucleic acid, plasmid, bacteriophage or virus) used to transfer protein coding information into a host cell.

The term "expression vector" or "expression construct" refers to a vector that is suitable for transformation of a host cell and contains nucleic acid sequences that direct and/or control (in conjunction with the host cell) expression of one or more heterologous coding regions operatively linked thereto. An expression construct can include, but is not limited to, sequences that affect or control transcription, translation, and, if introns are present, affect RNA splicing of a coding region operably linked thereto.

As used herein, "operably linked" means that the components to which the term is applied are in a relationship that allows them to carry out their inherent functions under suitable conditions. For example, a control sequence in a vector that is "operably linked" to a protein coding sequence is ligated thereto so that expression of the protein coding sequence is achieved under conditions compatible with the transcriptional activity of the control sequences.

The term "host cell" means a cell that has been transformed, or is capable of being transformed, with a nucleic acid sequence and thereby expresses a gene of interest. The term includes the progeny of the parent cell, whether or not the progeny is identical in morphology or in genetic make-up to the original parent cell, so long as the gene of interest is present.

The term "transduction" means the transfer of genes from one bacterium to another, usually by bacteriophage. "Transduction" also refers to the acquisition and transfer of eukaryotic cellular sequences by replication-defective retroviruses.

The term "transfection" means the uptake of foreign or exogenous DNA by a cell, and a cell has been "transfected" when the exogenous DNA has been introduced inside the cell membrane. A number of transfection techniques are well known in the art and are disclosed herein. See, e.g., Graham et al., (1973) *Virology* 52:456; Sambrook et al., (2001) Molecular Cloning: A Laboratory Manual, supra; Davis et al., (1986) *Basic Methods in Molecular Biology*, Elsevier; Chu et al., (1981) *Gene* 13:197. Such techniques can be used to introduce one or more exogenous DNA moieties into suitable host cells.

The term "transformation" refers to a change in a cell's genetic characteristics, and a cell has been transformed when it has been modified to contain new DNA or RNA. For example, a cell is transformed where it is genetically modified from its native state by introducing new genetic material via transfection, transduction, or other techniques. Following transfection or transduction, the transforming DNA can recombine with that of the cell by physically integrating into a chromosome of the cell, or can be maintained transiently as an episomal element without being replicated, or can replicate independently as a plasmid. A cell is considered to have been "stably transformed" when the transforming DNA is replicated with the division of the cell.

The terms "polypeptide" or "protein" are used interchangeably herein to refer to a polymer of amino acid residues. The terms also apply to amino acid polymers in which one or more amino acid residues is an analog or mimetic of a corresponding naturally occurring amino acid, as well as to naturally occurring amino acid polymers. The terms can also encompass amino acid polymers that have been modified, e.g., by the addition of carbohydrate residues to form glycoproteins, or phosphorylated. Polypeptides and proteins can be produced by a naturally-occurring and non-recombinant cell, or polypeptides and proteins can be produced by a genetically-engineered or recombinant cell. Polypeptides and proteins can comprise molecules having the amino acid sequence of a native protein, or molecules having deletions from, additions to, and/or substitutions of one or more amino acids of the native sequence. The terms "polypeptide" and "protein" encompass antigen binding proteins that specifically or selectively bind (i) β-Klotho; (ii) FGFR1c, FGFR2c, FGFR3c or FGFR4; or (iii) a complex comprising β-Klotho and one of FGFR1c, FGFR2c, FGFR3c, and FGFR4, or sequences that have deletions from, additions to, and/or substitutions of one or more amino acids of an antigen binding protein that specifically or selectively binds (i) β-Klotho; (ii) FGFR1c, FGFR2c, FGFR3c or FGFR4; or (iii) a complex comprising β-Klotho and one of FGFR1c, FGFR2c, FGFR3c, and FGFR4. The term "polypeptide fragment" refers to a polypeptide that has an amino-terminal deletion, a carboxyl-terminal deletion, and/or an internal deletion as compared with the full-length protein. Such fragments can also contain modified amino acids as compared with the full-length protein. In certain embodiments, fragments are about five to 500 amino acids long. For example, fragments can be at least 5, 6, 8, 10, 14, 20, 50, 70, 100, 110, 150, 200, 250, 300, 350, 400, or 450 amino acids long. Useful polypeptide fragments include immunologically functional fragments of antibodies, including binding domains. In the case of an antigen binding protein that binds to (i) β-Klotho; (ii) FGFR1c, FGFR2c, FGFR3c or FGFR4; or (iii) a complex comprising β-Klotho and one of FGFR1c, FGFR2c, FGFR3c, and FGFR4, useful fragments include but are not limited to a CDR region, a variable domain of a heavy or light chain, a portion of an antibody chain or just its variable region including two CDRs, and the like.

The term "isolated protein" referred means that a subject protein (1) is free of at least some other proteins with which it would normally be found, (2) is essentially free of other proteins from the same source, e.g., from the same species, (3) is expressed by a cell from a different species, (4) has been separated from at least about 50 percent of polynucleotides, lipids, carbohydrates, or other materials with which it is associated in nature, (5) is operably associated (by covalent or noncovalent interaction) with a polypeptide with which it is not associated in nature, or (6) does not occur in nature. Typically, an "isolated protein" constitutes at least about 5%, at least about 10%, at least about 25%, or at least about 50% of a given sample. Genomic DNA, cDNA, mRNA or other RNA, of synthetic origin, or any combination thereof can encode such an isolated protein. Preferably, the isolated protein is substantially free from proteins or polypeptides or other contaminants that are found in its natural environment that would interfere with its therapeutic, diagnostic, prophylactic, research or other use.

A "variant" of a polypeptide (e.g., an antigen binding protein, or an antibody) comprises an amino acid sequence wherein one or more amino acid residues are inserted into, deleted from and/or substituted into the amino acid sequence relative to another polypeptide sequence. Variants include fusion proteins.

A "derivative" of a polypeptide is a polypeptide (e.g., an antigen binding protein, or an antibody) that has been chemically modified in some manner distinct from insertion, deletion, or substitution variants, e.g., by conjugation to another chemical moiety.

The term "naturally occurring" as used throughout the specification in connection with biological materials such as polypeptides, nucleic acids, host cells, and the like, refers to materials which are found in nature.

"Antigen binding region" means a protein, or a portion of a protein, that specifically binds a specified antigen, e.g., FGFR1c, β-Klotho or both FGFR1c and β-Klotho. For example, that portion of an antigen binding protein that contains the amino acid residues that interact with an antigen and confer on the antigen binding protein its specificity and affinity for the antigen is referred to as "antigen binding region." An antigen binding region typically includes one or more "complementary binding regions" ("CDRs"). Certain antigen binding regions also include one or more "framework" regions. A "CDR" is an amino acid sequence that contributes to antigen binding specificity and affinity. "Framework" regions can aid in maintaining the proper conformation of the CDRs to promote binding between the antigen binding region and an antigen.

In certain aspects, recombinant antigen binding proteins that bind (i) β-Klotho; (ii) FGFR1c, FGFR2c, FGFR3c or FGFR4; or (iii) a complex comprising β-Klotho and one of FGFR1c, FGFR2c, FGFR3c, and FGFR4, are provided. In this context, a "recombinant protein" is a protein made using recombinant techniques, i.e., through the expression of a recombinant nucleic acid as described herein. Methods and techniques for the production of recombinant proteins are well known in the art.

The term "compete" when used in the context of antigen binding proteins (e.g., neutralizing antigen binding proteins, neutralizing antibodies, agonistic antigen binding proteins, agonistic antibodies and binding proteins that bind to (i) β-Klotho; (ii) FGFR1c, FGFR2c, FGFR3c or FGFR4; or (iii) a complex comprising β-Klotho and one of FGFR1c, FGFR2c, FGFR3c, and FGFR4) that compete for the same epitope or binding site on a target means competition between antigen binding proteins as determined by an assay in which the antigen binding protein (e.g., antibody or immunologically functional fragment thereof) under study prevents or inhibits the specific binding of a reference molecule (e.g., a reference ligand, or reference antigen binding protein, such as a reference antibody) to a common antigen (e.g., FGFR1c, FGFR2c, FGFR3c, FGFR4, β-Klotho or a fragment thereof). Numerous types of competitive binding assays can be used to determine if a test molecule competes with a reference molecule for binding. Examples of assays that can be employed include solid phase direct or indirect radioimmunoassay (RIA), solid phase direct or indirect enzyme immunoassay (EIA), sandwich competition assay (see, e.g., Stahli et al., (1983) *Methods in Enzymology* 9:242-253); solid phase direct biotin-avidin EIA (see, e.g., Kirkland et al., (1986) *J. Immunol.* 137:3614-3619) solid phase direct labeled assay, solid phase direct labeled sandwich assay (see, e.g., Harlow and Lane, (1988) *Antibodies, A Laboratory Manual*, Cold Spring Harbor Press); solid phase direct label RIA using 1-125 label (see, e.g., Morel et al., (1988) *Molec. Immunol.* 25:7-15); solid phase direct biotin-avidin EIA (see, e.g., Cheung, et al., (1990) *Virology* 176:546-552); and direct labeled RIA (Moldenhauer et al., (1990) *Scand. J. Immunol.* 32:77-82). Typically, such an assay involves the use of a purified antigen bound to a solid surface or cells bearing either of an unlabelled test antigen binding protein or a labeled reference antigen binding protein. Competitive inhibition is measured by determining the amount of label bound to the solid surface or cells in the presence of the test antigen binding protein. Usually the test antigen binding protein is present in excess. Antigen binding proteins identified by competition assay (competing antigen binding proteins) include antigen binding proteins binding to the same epitope as the reference antigen binding proteins and antigen binding proteins binding to an adjacent epitope sufficiently proximal to the epitope bound by the reference antigen binding protein for steric hindrance to occur. Additional details regarding methods for determining competitive binding are provided in the examples herein. Usually, when a competing antigen binding protein is present in excess, it will inhibit specific binding of a reference antigen binding protein to a common antigen by at least 40%, 45%, 50%, 55%, 60%, 65%, 70% or 75%. In some instance, binding is inhibited by at least 80%, 85%, 90%, 95%, or 97% or more.

The term "antigen" refers to a molecule or a portion of a molecule capable of being bound by a selective binding agent, such as an antigen binding protein (including, e.g., an antibody or immunological functional fragment thereof), and may also be capable of being used in an animal to produce antibodies capable of binding to that antigen. An antigen can possess one or more epitopes that are capable of interacting with different antigen binding proteins, e.g., antibodies.

The term "epitope" means the amino acids of a target molecule that are contacted by an antigen binding protein (for example, an antibody) when the antigen binding protein is bound to the target molecule. The term includes any subset of the complete list of amino acids of the target molecule that are contacted when an antigen binding protein, such as an antibody, is bound to the target molecule. An epitope can be contiguous or non-contiguous (e.g., (i) in a single-chain polypeptide, amino acid residues that are not contiguous to one another in the polypeptide sequence but that within in context of the target molecule are bound by the antigen binding protein, or (ii) in a multimeric receptor comprising two or more individual components, e.g., (i) FGFR1c, FGFR2c, FGFR3c or FGFR4, and (ii) β-Klotho, amino acid residues that are present on one or more of the individual components, but which are still bound by the antigen binding protein). In certain embodiments, epitopes can be mimetic in that they comprise a three dimensional structure that is similar to an antigenic epitope used to generate the antigen binding protein, yet comprise none or only some of the amino acid residues found in that epitope used to generate the antigen binding protein. Most often, epitopes reside on proteins, but in some instances can reside on other kinds of molecules, such as nucleic acids. Epitope determinants can include chemically active surface groupings of molecules such as amino acids, sugar side chains, phosphoryl or sulfonyl groups, and can have specific three dimensional structural characteristics, and/or specific charge characteristics. Generally, antigen binding proteins specific for a particular target molecule will preferentially recognize an epitope on the target molecule in a complex mixture of proteins and/or macromolecules.

The term "identity" refers to a relationship between the sequences of two or more polypeptide molecules or two or more nucleic acid molecules, as determined by aligning and comparing the sequences. "Percent identity" means the percent of identical residues between the amino acids or nucleotides in the compared molecules and is calculated based on the size of the smallest of the molecules being compared. For these calculations, gaps in alignments (if any) must be addressed by a particular mathematical model or computer program (i.e., an "algorithm"). Methods that can be used to calculate the identity of the aligned nucleic acids or polypeptides include those described in *Computational Molecular Biology*, (Lesk, A. M., ed.), (1988) New York: Oxford University Press; Biocomputing Informatics and Genome Projects, (Smith, D. W., ed.), 1993, New York: Academic Press; Computer Analysis of Sequence Data, Part I, (Griffin, A. M., and Griffin, H. G., eds.), 1994, New Jersey: Humana Press; von Heinje, G., (1987) Sequence Analysis in Molecular Biology, New York: Academic Press; Sequence Analysis Primer, (Gribskov, M. and Devereux, J., eds.), 1991, New York: M. Stockton Press; and Carillo et al., (1988) *SIAM J. Applied Math.* 48:1073.

In calculating percent identity, the sequences being compared are aligned in a way that gives the largest match between the sequences. The computer program used to determine percent identity is the GCG program package, which includes GAP (Devereux et al., (1984) *Nucl. Acid Res.* 12:387; Genetics Computer Group, University of Wisconsin, Madison, Wis.). The computer algorithm GAP is used to align the two polypeptides or polynucleotides for which the percent sequence identity is to be determined. The sequences are aligned for optimal matching of their respective amino acid or nucleotide (the "matched span", as determined by the algorithm). A gap opening penalty (which is calculated as 3× the average diagonal, wherein the "average diagonal" is the average of the diagonal of the comparison matrix being used; the "diagonal" is the score or number assigned to each perfect amino acid match by the particular comparison matrix) and a gap extension penalty (which is usually 1/10 times the gap opening penalty), as well as a comparison matrix such as PAM 250 or BLOSUM 62 are used in conjunction with the algorithm. In certain embodiments, a standard comparison matrix (see, Dayhoff et al., (1978) *Atlas of Protein Sequence and Structure* 5:345-352 for the PAM 250 comparison matrix; Henikoff et al., (1992) *Proc. Natl. Acad. Sci. U.S.A.* 89:10915-10919 for the BLOSUM 62 comparison matrix) is also used by the algorithm.

Recommended parameters for determining percent identity for polypeptides or nucleotide sequences using the GAP program are the following:

Algorithm: Needleman et al., 1970, *J. Mol. Biol.* 48:443-453;

Comparison matrix: BLOSUM 62 from Henikoff et al., 1992, supra;

Gap Penalty: 12 (but with no penalty for end gaps)

Gap Length Penalty: 4

Threshold of Similarity: 0

Certain alignment schemes for aligning two amino acid sequences can result in matching of only a short region of the two sequences, and this small aligned region can have very high sequence identity even though there is no significant relationship between the two full-length sequences. Accordingly, the selected alignment method (e.g., the GAP program) can be adjusted if so desired to result in an alignment that spans at least 50 contiguous amino acids of the target polypeptide.

As used herein, "substantially pure" means that the described species of molecule is the predominant species present, that is, on a molar basis it is more abundant than any other individual species in the same mixture. In certain embodiments, a substantially pure molecule is a composition wherein the object species comprises at least 50% (on a molar basis) of all macromolecular species present. In other embodiments, a substantially pure composition will comprise at least 80%, 85%, 90%, 95%, or 99% of all macromolecular species present in the composition. In other embodiments, the object species is purified to essential homogeneity wherein contaminating species cannot be detected in the composition by conventional detection methods and thus the composition consists of a single detectable macromolecular species.

The terms "treat" and "treating" refer to any indicia of success in the treatment or amelioration of an injury, pathology or condition, including any objective or subjective parameter such as abatement; remission; diminishing of symptoms or making the injury, pathology or condition more tolerable to the patient; slowing in the rate of degeneration or decline; making the final point of degeneration less debilitating; improving a patient's physical or mental well-being. The treatment or amelioration of symptoms can be based on objective or subjective parameters; including the results of a physical examination, neuropsychiatric exams, and/or a psychiatric evaluation. For example, certain methods presented herein can be employed to treat Type 2 diabetes, obesity and/or dyslipidemia, either prophylactically or as an acute treatment, to decrease plasma glucose levels, to decrease circulating triglyceride levels, to decrease circulating cholesterol levels and/or ameliorate a symptom associated with type 2 diabetes, obesity and dyslipidemia.

An "effective amount" is generally an amount sufficient to reduce the severity and/or frequency of symptoms, eliminate the symptoms and/or underlying cause, prevent the occurrence of symptoms and/or their underlying cause, and/or improve or remediate the damage that results from or is associated with diabetes, obesity and dyslipidemia. In some embodiments, the effective amount is a therapeutically effective amount or a prophylactically effective amount. A "therapeutically effective amount" is an amount sufficient to remedy a disease state (e.g., diabetes, obesity or dyslipidemia) or symptoms, particularly a state or symptoms associated with the disease state, or otherwise prevent, hinder, retard or reverse the progression of the disease state or any other undesirable symptom associated with the disease in any way whatsoever. A "prophylactically effective amount" is an amount of a pharmaceutical composition that, when administered to a subject, will have the intended prophylactic effect, e.g., preventing or delaying the onset (or reoccurrence) of diabetes, obesity or dyslipidemia, or reducing the likelihood of the onset (or reoccurrence) of diabetes, obesity or dyslipidemia or associated symptoms. The full therapeutic or prophylactic effect does not necessarily occur by administration of one dose, and can occur only after administration of a series of doses. Thus, a therapeutically or prophylactically effective amount can be administered in one or more administrations.

"Amino acid" takes its normal meaning in the art. The twenty naturally-occurring amino acids and their abbreviations follow conventional usage. See, Immunology-A Synthesis, $2^{nd}$ Edition, (E. S. Golub and D. R. Green, eds.), Sinauer Associates: Sunderland, Mass. (1991), incorporated herein by reference for any purpose. Stereoisomers (e.g., D-amino acids) of the twenty conventional amino acids, unnatural or non-naturally occurring amino acids such as α-,α-disubstituted amino acids, N-alkyl amino acids, and other unconventional amino acids can also be suitable components for polypeptides and are included in the phrase "amino acid." Examples of non-naturally amino acids (which can be substituted for any naturally-occurring amino acid found in any sequence disclosed herein, as desired) include: 4-hydroxyproline, γ-carboxyglutamate, ε-N,N,N-trimethyllysine, ε-N-acetyllysine, O-phosphoserine, N-acetylserine, N-formylmethionine, 3-methylhistidine, 5-hydroxylysine, σ-N-methylarginine, and other similar amino acids and imino acids (e.g., 4-hydroxyproline). In the polypeptide notation used herein, the left-hand direction is the amino terminal direction and the right-hand direction is the carboxyl-terminal direction, in accordance with standard usage and convention. A non-limiting lists of examples of non-naturally occurring amino acids that can be inserted into an antigen binding protein sequence or substituted for a wild-type residue in an antigen binding sequence include β-amino acids, homoamino acids, cyclic amino acids and amino acids with derivatized side chains. Examples include (in the L-form or D-form; abbreviated as in parentheses): citrulline (Cit), homocitrulline (hCit), Nα-methylcitrulline (NMeCit), Nα-methylhomocitrulline (Nα-MeHoCit), ornithine (Orn), Nα-Methylornithine (Nα-MeOrn or NMeOrn), sarcosine (Sar), homolysine (hLys or hK), homoarginine (hArg or hR), homoglutamine (hQ), Nα-methylarginine (NMeR), Nα-methylleucine (Nα-MeL or NMeL), N-methylhomolysine (NMeHoK), Nα-methylglutamine (NMeQ), norleucine (Nle), norvaline (Nva), 1,2,3,4-tetrahydroisoquinoline (Tic), Octahydroindole-2-carboxylic acid (Oic), 3-(1-naphthyl)alanine (1-Nal), 3-(2-naphthyl)alanine (2-Nal), 1,2,3,4-tetrahydroisoquinoline (Tic), 2-indanylglycine (IgI), para-iodophenylalanine (pI-Phe), para-aminophenylalanine (4AmP or 4-Amino-Phe), 4-guanidino phenylalanine (Guf), glycyllysine (abbreviated "K(Nε-glycyl)" or "K(glycyl)" or "K(gly)"), nitrophenylalanine (nitrophe), aminophenylalanine (aminophe or Amino-Phe), benzylphenylalanine (benzylphe), γ-carboxyglutamic acid (γ-carboxyglu), hydroxyproline (hydroxypro), p-carboxyl-phenylalanine (Cpa), α-aminoadipic acid (Aad), Nα-methyl valine (NMeVal), N-α-methyl leucine (NMeLeu), Nα-methylnorleucine (NMeNle), cyclopentylglycine (Cpg), cyclohexylglycine (Chg), acetylarginine (acetylarg), α, β-diaminopropionoic acid (Dpr), α, γ-diaminobutyric acid (Dab), diaminopropionic acid (Dap), cyclohexylalanine (Cha), 4-methyl-phenylalanine (MePhe), β, β-diphenyl-alanine (BiPhA), aminobutyric acid (Abu), 4-phenyl-phenylalanine (or biphenylalanine; 4Bip), α-amino-isobutyric acid (Aib), beta-alanine, beta-aminopropionic acid, piperidinic acid, aminocaprioic acid, aminoheptanoic acid, aminopimelic acid, desmosine, diaminopimelic acid, N-ethylglycine, N-ethylaspargine, hydroxylysine, allo-hydroxylysine, isodesmosine, allo-isoleucine, N-methylglycine, N-methylisoleucine, N-methylvaline, 4-hydroxyproline (Hyp), γ-carboxyglutamate, ε-N,N,N-trimethyllysine, ε-N-acetyllysine, O-phosphoserine, N-acetylserine, N-formylmethionine, 3-methylhistidine, 5-hydroxylysine, ω-methylarginine, 4-Amino-O-Phthalic Acid (4APA), and other similar amino acids, and derivatized forms of any of those specifically listed.

II. General Overview

Antigen-binding proteins that bind (i) β-Klotho; (ii) FGFR1c, FGFR2c, FGFR3c or FGFR4; or (iii) a complex comprising β-Klotho and one of FGFR1c, FGFR2c, FGFR3c, and FGFR4, are provided herein. A unique property of the antigen binding proteins disclosed herein is the agonistic nature of these proteins, specifically the ability to mimic the in vivo effect of FGF21 and to induce FGF21-like signaling. More remarkably and specifically, some of the antigen binding proteins disclosed herein induce FGF21-like signaling in several in vitro cell-based assay, including the ELK-luciferase reporter assay of Example 5 under the following conditions: (1) the binding to and activity of the FGF21 receptor is β-Klotho dependent; (2) the activity is selective to FGFR1c/βKlotho complex; (3) the binding to the FGFR1c/βKlotho triggers FGF21-like signaling pathways; and (4) the potency (EC50) is comparable to a wild-type FGF21 standard comprising the mature form of SEQ ID NO:2, as measured in the following cell-based assays: (1) the recombinant FGF21 receptor mediated luciferase-reporter cell assay of Example 5; (2) the ERK-phosphorylation in the recombinant FGF21 receptor mediated cell assay of Example 5; and (3) ERK-phosphorylation in human adipocytes as described in more details in Example 7. The disclosed antigen binding proteins, therefore, are expected to exhibit activities in vivo that are consistent with the natural biological function of FGF21. This property makes the disclosed antigen binding proteins viable therapeutics for the treatment of metabolic diseases such as type 2 diabetes, obesity, dyslipidemia, NASH, cardiovascular disease, metabolic syndrome and broadly any disease or condition in which it is desirable to mimic or augment the in vivo effects of FGF21.

In some embodiments of the present disclosure the antigen binding proteins provided can comprise polypeptides into which one or more complementary determining regions (CDRs) can be embedded and/or joined. In such antigen binding proteins, the CDRs can be embedded into a "framework" region, which orients the CDR(s) such that the proper antigen binding properties of the CDR(s) is achieved. In general, such antigen binding proteins that are provided can facilitate or enhance the interaction between FGFR1c and β-Klotho, and can substantially induce FGF21-like signaling.

Certain antigen binding proteins described herein are antibodies or are derived from antibodies. In certain embodiments, the polypeptide structure of the antigen binding proteins is based on antibodies, including, but not limited to, monoclonal antibodies, bispecific antibodies, minibodies, domain antibodies, synthetic antibodies (sometimes referred to herein as "antibody mimetics"), chimeric antibodies, humanized antibodies, human antibodies, antibody fusions (sometimes referred to herein as "antibody conjugates"), hemibodies and fragments thereof. The various structures are further described herein below.

The antigen binding proteins provided herein have been demonstrated to bind to (i) β-Klotho; (ii) FGFR1c, FGFR2c, FGFR3c or FGFR4; or (iii) a complex comprising β-Klotho and one of FGFR1c, FGFR2c, FGFR3c, and FGFR4, and particularly to (i) human β-Klotho; (ii) human FGFR1c, human FGFR2c, human FGFR3c or human FGFR4; or (iii) a complex comprising human β-Klotho and one of human FGFR1c, human FGFR2c, human FGFR3c, and human FGFR4. As described and shown in the Examples presented herein, based on the Western blot results, commercially-available anti-β-Klotho or anti-FGFR1c antibodies bind to denatured β-Klotho or FGFR1c whereas the antigen binding protein (agonistic antibodies) do not. Conversely, the provided antigen binding proteins recognize the native structure of the FGFR1c and β-Klotho on the cell surface whereas the commercial antibodies do not, based on the FACS results provided. See Example 9. The antigen binding proteins that are provided therefore mimic the natural in vivo biological activity of FGF21. As a consequence, the antigen binding proteins provided herein are capable of activating FGF21-like signaling activity. In particular, the disclosed antigen binding proteins can have one or more of the following activities in vivo: induction of FGF21-like signal transduction pathways, lowering blood glucose levels, lowering circulating lipid levels, improving metabolic parameters and other physiological effects induced in vivo by the formation of the ternary complex of FGFR1c, β-Klotho and FGF21, for example in conditions such as type 2 diabetes, obesity, dyslipidemia, NASH, cardiovascular disease, and metabolic syndrome.

The antigen binding proteins that specifically bind to (i) β-Klotho; (ii) FGFR1c, FGFR2c, FGFR3c or FGFR4; or (iii) a complex comprising β-Klotho and one of FGFR1c, FGFR2c, FGFR3c, and FGFR4 that are disclosed herein have a variety of utilities. Some of the antigen binding proteins, for instance, are useful in specific binding assays, in the affinity purification of (i) β-Klotho; (ii) FGFR1c, FGFR2c, FGFR3c or FGFR4; or (iii) a complex comprising β-Klotho and one of FGFR1c, FGFR2c, FGFR3c, and FGFR4, including the human forms of these disclosed proteins, and in screening assays to identify other agonists of FGF21-like signaling activity.

The antigen binding proteins that specifically bind (i) β-Klotho; (ii) FGFR1c, FGFR2c, FGFR3c or FGFR4; or (iii) a complex comprising β-Klotho and one of FGFR1c, FGFR2c, FGFR3c, and FGFR4 that are disclosed herein can be used in a variety of treatment applications, as explained herein. For example, certain antigen binding proteins are useful for treating conditions associated with FGF21-like signaling processes in a patient, such as reducing, alleviating, or treating type 2 diabetes, obesity, dyslipidemia, NASH, cardiovascular disease, and metabolic syndrome. Other uses for the antigen binding proteins include, for example, diagnosis of diseases or conditions associated with β-Klotho, FGFR1c, FGFR2c, FGFR3c, FGFR4 or FGF21, and screening assays to determine the presence or absence of these molecules. Some of the antigen binding proteins described herein can be useful in treating conditions, symptoms and/or the pathology associated with decreased FGF21-like signaling activity. Exemplary conditions include, but are not limited to, diabetes, obesity, NASH and dyslipidemia.

FGF21

The antigen binding proteins disclosed herein induce FGF21-mediated signaling, as defined herein. In vivo, the mature form of FGF21 is the active form of the molecule. The nucleotide sequence encoding full length FGF21 is provided; the nucleotides encoding the signal sequence are underlined.

(SEQ ID NO: 1)
ATG GAC TCG GAC GAG ACC GGG TTC GAG CAC TCA GGA CTG TGG GTT TCT GTG
CTG GCT GGT CTT CTG CTG GGA GCC TGC CAG GCA CAC CCC ATC CCT GAC TCC
AGT CCT CTC CTG CAA TTC GGG GGC CAA GTC CGG CAG CGG TAC CTC TAC ACA
GAT GAT GCC CAG CAG ACA GAA GCC CAC CTG GAG ATC AGG GAG GAT GGG
ACG GTG GGG GGC GCT GCT GAC CAG AGC CCC GAA AGT CTC CTG CAG CTG
AAA GCC TTG AAG CCG GGA GTT ATT CAA ATC TTG GGA GTC AAG ACA TCC
AGG TTC CTG TGC CAG CGG CCA GAT GGG GCC CTG TAT GGA TCG CTC CAC TTT
GAC CCT GAG GCC TGC AGC TTC CGG GAG CTG CTT CTT GAG GAC GGA TAC AAT
GTT TAC CAG TCC GAA GCC CAC GGC CTC CCG CTG CAC CTG CCA GGG AAC AAG
TCC CCA CAC CGG GAC CCT GCA CCC CGA GGA CCA GCT CGC TTC CTG CCA CTA
CCA GGC CTG CCC CCC GCA CCC CCG GAG CCA CCC GGA ATC CTG GCC CCC CAG
CCC CCC GAT GTG GGC TCC TCG GAC CCT CTG AGC ATG GTG GGA CCT TCC CAG
GGC CGA AGC CCC AGC TAC GCT TCC TGA

The amino acid sequence of full length FGF21 is provided; the amino acids that make up the signal sequence are underlined:

(SEQ ID NO: 2)
<u>M D S D E T G F E H S G L W V S V L A G L L L G A C Q A</u> H P I P D S S P L L Q F G G Q
V R Q R Y L Y T D D A Q Q T E A H L E I R E D G T V G G A A D Q S P E S L L Q L K A
L K P G V I Q I L G V K T S R F L C Q R P D G A L Y G S L H F D P E A C S F R E L L L E
D G Y N V Y Q S E A H G L P L H L P G N K S P H R D P A P R G P A R F L P L P G L P P
A P P E P P G I L A P Q P P D V G S S D P L S M V G P S Q G R S P S Y A S

FGFR1c

The antigen binding proteins disclosed herein bind to FGFR1c, in particular human FGFR1c, when associated with β-Klotho. The nucleotide sequence encoding human FGFR1c (GenBank™ Accession Number NM_023110) is provided:

(SEQ ID NO: 3)
ATGTGGAGCTGGAAGTGCCTCCTCTTCTGGGCTGTGCTGGTCACAGCC
ACACTCTGCACCGCTAGGCCGTCCCCGACCTTGCCTGAACAAGCCCAG
CCCTGGGGAGCCCCTGTGGAAGTGGAGTCCTTCCTGGTCCACCCCGGT
GACCTGCTGCAGCTTCGCTGTCGGCTGCGGGACGATGTGCAGAGCATC
AACTGGCTGCGGGACGGGGTGCAGCTGGCGGAAAGCAACCGCACCCG
CATCACAGGGGAGGAGGTGGAGGTGCAGGACTCCGTGCCCGCAGACT
CCGGCCTCTATGCTTGCGTAACCAGCAGCCCCTCGGGCAGTGACACCA
CCTACTTCTCCGTCAATGTTTCAGATGCTCTCCCCTCCTCGGAGGATGA
TGATGATGATGACTCCTCTTCAGAGGAGAAAGAAACAGATAACA
CCAAACCAAACCGTATGCCCGTAGCTCCATATTGGACATCACCAGAAA
AGATGGAAAAGAAATTGCATGCAGTGCCGGCTGCCAAGACAGTGAAG
TTCAAATGCCCTTCCAGTGGGACACCAAACCCAACACTGCGCTGGTTG
AAAAATGGCAAAGAATTCAAACCTGACCACAGAATTGGAGGCTACAA
GGTCCGTTATGCCACCTGGAGCATCATAATGGACTCTGTGGTGCCCTC
TGACAAGGGCAACTACACCTGCATTGTGGAGAATGAGTACGGCAGCA
TCAACCACACATACCAGCTGGATGTCGTGGAGCGGTCCCCTCACCGGC
CCATCCTGCAAGCAGGGTTGCCCGCCAACAAAACAGTGGCCCTGGGT
AGCAACGTGGAGTTCATGTGTAAGGTGTACAGTGACCCGCAGCCGCAC
ATCCAGTGGCTAAAGCACATCGAGGTGAATGGGAGCAAGATTGGCCC
AGACAACCTGCCTTATGTCCAGATCTTGAAGACTGCTGGAGTTAATAC
CACCGACAAAGAGATGGAGGTGCTTCACTTAAGAAATGTCTCCTTTGA
GGACGCAGGGGAGTATACGTGCTTGGCGGGTAACTCTATCGGACTCTC
CCATCACTCTGCATGGTTGACCGTTCTGGAAGCCCTGGAAGAGAGGCC
GGCAGTGATGACCTCGCCCCTGTACCTGGAGATCATCATCTATTGCAC
AGGGGCCTTCCTCATCTCCTGCATGGTGGGGTCGGTCATCGTCTACAA
GATGAAGAGTGGTACCAAGAAGAGTGACTTCCACAGCCAGATGGCTG
TGCACAAGCTGGCCAAGAGCATCCCTCTGCGCAGACAGGTAACAGTG
TCTGCTGACTCCAGTGCATCCATGAACTCTGGGGTTCTTCTGGTTCGGC
CATCACGGCTCTCCTCCAGTGGGACTCCCATGCTAGCAGGGGTCTCTG

-continued
```
AGTATGAGCTTCCCGAAGACCCTCGCTGGGAGCTGCCTCGGGACAGAC
TGGTCTTAGGCAAACCCCTGGGAGAGGGCTGCTTTGGGCAGGTGGTGT
TGGCAGAGGCTATCGGGCTGGACAAGGACAAACCCAACCGTGTGACC
AAAGTGGCTGTGAAGATGTTGAAGTCGGACGCAACAGAGAAAGACTT
GTCAGACCTGATCTCAGAAATGGAGATGATGAAGATGATCGGGAAGC
ATAAGAATATCATCAACCTGCTGGGGCCTGCACGCAGGATGGTCCCT
TGTATGTCATCGTGGAGTATGCCTCCAAGGGCAACCTGCGGGAGTACC
TGCAGGCCCGGAGGCCCCCAGGGCTGGAATACTGCTACAACCCCAGC
CACAACCCAGAGGAGCAGCTCTCCTCCAAGGACCTGGTGTCCTGCGCC
TACCAGGTGGCCCGAGGCATGGAGTATCTGGCCTCCAAGAAGTGCATA
CACCGAGACCTGGCAGCCAGGAATGTCCTGGTGACAGAGGACAATGT
GATGAAGATAGCAGACTTTGGCCTCGCACGGGACATTCACCACATCGA
CTACTATAAAAAGACAACCAACGGCCGACTGCCTGTGAAGTGGATGG
CACCCGAGGCATTATTTGACCGGATCTACACCCACCAGAGTGATGTGT
GGTCTTTCGGGGTGCTCCTGTGGGAGATCTTCACTCTGGGCGGCTCCCC
ATACCCCGGTGTGCCTGTGGAGGAACTTTTCAAGCTGCTGAAGGAGGG
TCACCGCATGGACAAGCCCAGTAACTGCACCAACGAGCTGTACATGAT
GATGCGGGACTGCTGGCATGCAGTGCCCTCACAGAGACCCACCTTCAA
GCAGCTGGTGGAAGACCTGGACCGCATCGTGGCCTTGACCTCCAACCA
GGAGTACCTGGACCTGTCCATGCCCCTGGACCAGTACTCCCCCAGCTT
TCCCGACACCCGGAGCTCTACGTGCTCCTCAGGGGAGGATTCCGTCTT
CTCTCATGAGCCGCTGCCCGAGGAGCCCTGCCTGCCCCGACACCCAGC
CCAGCTTGCCAATGGCGGACTCAAACGCCGCTGA.
```

The amino acid sequence of human FGFR1c (GenBank™ Accession Number NP_075598)is provided:

```
                                        (SEQ ID NO: 4)
MWSWKCLLFWAVLVTATLCTARPSPTLPEQAQPWGAPVEVESFLVHPG
DLLQLRCRLRDDVQSINWLRDGVQLAESNRTRITGEEVEVQDSVPADSGL
YACVTSSPSGSDTTYFSVNVSDALPSSEDDDDDDSSSEEKETDNTKPNR
MPVAPYWTSPEKMEKKLHAVPAAKTVKFKCPSSGTPNPTLRWLKNGKEF
KPDHRIGGYKVRYATWSIIMDSVVPSDKGNYTCIVENEYGSINHTYQLDV
VERSPHRPILQAGLPANKTVALGSNVEFMCKVYSDPQPHIQWLKHIEVNG
SKIGPDNLPYVQILKTAGVNTTDKEMEVLHLRNVSFEDAGEYTCLAGNSI
GLSHHSAWLTVLEALEERPAVMTSPLYLEIIIYCTGAFLISCMVGSVIVY
KMKSGTKKSDFHSQMAVHKLAKSIPLRRQVTVSADSSASMNSGVLLVRPS
RLSSSGTPMLAGVSEYELPEDPRWELPRDRLVLGKPLGEGCFGQVVLAEA
IGLDKDKPNRVTKVAVKMLKSDATEKDLSDLISEMEMMKMIGKHKNIIN
LLGACTQDGPLYVIVEYASKGNLREYLQARRPPGLEYCYNPSHNPEEQLS
SKDLVSCAYQVARGMEYLASKKCIHRDLAARNVLVTEDNVMKIADFGL
ARDIHHIDYYKKTTNGRLPVKWMAPEALFDRIYTHQSDVWSFGVLLWEI
FTLGGSPYPGVPVEELFKLLKEGHRMDKPSNCTNELYMMMRDCWHAVP
SQRPTFKQLVEDLDRIVALTSNQEYLDLSMPLDQYSPSFPDTRSSTCSSG
EDSVFSHEPLPEEPCLPRHPAQLANGGLKRR.
```

The antigen binding proteins described herein bind the extracellular portion of FGFR1c. An example of an extracellular region of FGFR1c is:

```
                                        (SEQ ID NO: 5)
MWSWKCLLFWAVLVTATLCTARPSPTLPEQAQPWGAPVEVESFLVHPGDL
LQLRCRLRDDVQSINWLRDGVQLAESNRTRITGEEVEVQDSVPADSGLYA
CVTSSPSGSDTTYFSVNVSDALPSSEDDDDDDDSSSEEKETDNTKPNRMP
VAPYWTSPEKMEKKLHAVPAAKTVKFKCPSSGTPNPTLRWLKNGKEFKPD
HRIGGYKVRYATWSIIMDSVVPSDKGNYTCIVENEYGSINHTYQLDVVER
SPHRPILQAGLPANKTVALGSNVEFMCKVYSDPQPHIQWLKHIEVNGSKI
GPDNLPYVQILKTAGVNTTDKEMEVLHLRNVSFEDAGEYTCLAGNSIGLS
HHSAWLTVLEALEERPAVMTSPLY.
```

As described herein, FGFR1c proteins can also include fragments. As used herein, the terms are used interchangeably to mean a receptor, in particular and unless otherwise specified, a human receptor, that upon association with β-Klotho and FGF21 induces FGF21-like signaling activity.

The term FGFR1c also includes post-translational modifications of the FGFR1c amino acid sequence, for example, possible N-linked glycosylation sites. Thus, the antigen binding proteins can bind to or be generated from proteins glycosylated at one or more of the positions.

β-Klotho

The antigen binding proteins disclosed herein bind to β-Klotho, in particular human β-Klotho. The nucleotide sequence encoding human β-Klotho (GenBank™ Accession Number NM_175737) is provided:

```
                                        (SEQ ID NO: 6)
ATGAAGCCAGGCTGTGCGGCAGGATCTCCAGGGAATGAATGGATTTTC
TTCAGCACTGATGAAATAACCACACGCTATAGGAATACAATGTCCAAC
GGGGGATTGCAAAGATCTGTCATCCTGTCAGCACTTATTCTGCTACGA
GCTGTTACTGGATTCTCTGGAGATGGAAGAGCTATATGGTCTAAAAAT
CCTAATTTTACTCCGGTAAATGAAAGTCAGCTGTTTCTCTATGACACTT
TCCCTAAAAACTTTTTCTGGGGTATTGGGACTGGAGCATTGCAAGTGG
AAGGGAGTTGGAAGAAGGATGGAAAAGGACCTTCTATATGGGATCAT
TTCATCCACACACACCTTAAAAATGTCAGCAGCACGAATGGTTCCAGT
GACAGTTATATTTTTCTGGAAAAAGACTTATCAGCCCTGGATTTTATAG
GAGTTTCTTTTTATCAATTTTCAATTTCCTGGCCAAGGCTTTTCCCCGAT
GGAATAGTAACAGTTGCCAACGCAAAAGGTCTGCAGTACTACAGTACT
CTTCTGGACGCTCTAGTGCTTAGAAACATTGAACCTATAGTTACTTTAT
ACCACTGGGATTTGCCTTTGGCACTACAAGAAAATATGGGGGTGGA
AAAATGATACCATAATAGATATCTTCAATGACTATGCCACATACTGTT
TCCAGATGTTTGGGGACCGTGTCAAATATTGGATTACAATTCACAACC
CATATCTAGTGGCTTGGCATGGGTATGGGACAGGTATGCATGCCCCTG
```

-continued

```
GAGAGAAGGGAAATTTAGCAGCTGTCTACACTGTGGGACACAACTTG
ATCAAGGCTCACTCGAAAGTTTGGCATAACTACAACACACATTTCCGC
CCACATCAGAAGGGTTGGTTATCGATCACGTTGGGATCTCATTGGATC
GAGCCAAACCGGTCGGAAAACACGATGGATATATTCAAATGTCAACA
ATCCATGGTTTCTGTGCTTGGATGGTTTGCCAACCCTATCCATGGGAT
GGCGACTATCCAGAGGGATGAGAAAGAAGTTGTTCTCCGTTCTACCC
ATTTTCTCTGAAGCAGAGAAGCATGAGATGAGAGGCACAGCTGATTTC
TTTGCCTTTTCTTTTGGACCCAACAACTTCAAGCCCCTAAACACCATGG
CTAAAATGGGACAAAATGTTTCACTTAATTTAAGAGAAGCGCTGAACT
GGATTAAACTGGAATACAACAACCCTCGAATCTTGATTGCTGAGAATG
GCTGGTTCACAGACAGTCGTGTGAAAACAGAAGACACCACGGCCATC
TACATGATGAAGAATTTCCTCAGCCAGGTGCTTCAAGCAATAAGGTTA
GATGAAATACGAGTGTTTGGTTATACTGCCTGGTCTCTCCTGGATGGCT
TTGAATGGCAGGATGCTTACACCATCCGCCGAGGATTATTTTATGTGG
ATTTTAACAGTAAACAGAAAGAGCGGAAACCTAAGTCTTCAGCACACT
ACTACAAACAGATCATACGAGAAATGGTTTTTCTTTAAAAGAGTCCA
CGCCAGATGTGCAGGGCCAGTTTCCCTGTGACTTCTCCTGGGGTGTCA
CTGAATCTGTTCTTAAGCCCGAGTCTGTGGCTTCGTCCCCACAGTTCAG
CGATCCTCATCTGTACGTGTGGAACGCCACTGGCAACAGACTGTTGCA
CCGAGTGGAAGGGGTGAGGCTGAAAACACGACCCGCTCAATGCACAG
ATTTTGTAAACATCAAAAAACAACTTGAGATGTTGGCAAGAATGAAA
GTCACCCACTACCGGTTTGCTCTGGATTGGGCCTCGGTCCTTCCCACTG
GCAACCTGTCCGCGGTGAACCGACAGGCCCTGAGGTACTACAGGTGC
GTGGTCAGTGAGGGGCTGAAGCTTGGCATCTCCGCGATGGTCACCCTG
TATTATCCGACCCACGCCCACCTAGGCCTCCCCGAGCCTCTGTTGCAT
GCCGACGGGTGGCTGAACCCATCGACGGCCGAGGCCTTCCAGGCCTA
CGCTGGGCTGTGCTTCCAGGAGCTGGGGGACCTGGTGAAGCTCTGGAT
CACCATCAACGAGCCTAACCGGCTAAGTGACATCTACAACCGCTCTGG
CAACGACACCTACGGGGCGGCACAACCTGCTGGTGGCCCACGCCC
TGGCCTGGCGCCTCTACGACCGGCAGTTCAGGCCCTCACAGCGCGGGG
CCGTGTCGCTGTCGCTGCACGCGGACTGGGCGGAACCCGCCAACCCCT
ATGCTGACTCGCACTGGAGGGCGGCCGAGCGCTTCCTGCAGTTCGAGA
TCGCCTGGTTCGCCGAGCCGCTCTTCAAGACCGGGGACTACCCCGCGG
CCATGAGGGAATACATTGCCTCCAAGCACCGACGGGGCTTTCCAGCT
CGGCCCTGCCGCGCCTCACCGAGGCCGAAAGGAGGCTGCTCAAGGGC
ACGGTCGACTTCTGCGCGCTCAACCACTTCACCACTAGGTTCGTGATG
CACGAGCAGCTGGCCGGCAGCCGCTACGACTCGGACAGGGACATCCA
GTTTCTGCAGGACATCACCCGCCTGAGCTCCCCACGCGCCTGGCTGT
GATTCCCTGGGGGGTGCGCAAGCTGCTGCGGTGGGTCCGGAGGAACT
ACGGCGACATGGACATTTACATCACCGCCAGTGGCATCGACGACCAG
GCTCTGGAGGATGACCGGCTCCGGAAGTACTACCTAGGGAAGTACCTT
CAGGAGGTGCTGAAAGCATACCTCGATTGATAAAGTCAGAATCAAAGG
CTATTATGCATTCAAACTGGCTGAAGAGAAATCTAAACCCAGATTTGG
ATTCTTCACATCTGATTTTAAAGCTAAATCCTCAATACAATTTTACAAC
AAAGTGATCAGCAGCAGGGGCTTCCCTTTTGAGAACAGTAGTTCTAGA
TGCAGTCAGACCCAAGAAAATACAGAGTGCACTGTCTGCTTATTCCTT
GTGCAGAAGAAACCACTGATATTCCTGGGTTGTTGCTTCTTCTCCACCC
TGGTTCTACTCTTATCAATTGCCATTTTTCAAAGGCAGAAGAGAAGAA
AGTTTTGGAAAGCAAAAAACTTACAACACATACCATTAAAGAAAGGC
AAGAGAGTTGTTAGCTAA.
```

The amino acid sequence of full length human β-Klotho (GenBank™ Accession Number NP_783864) is provided:

```
                                       (SEQ ID NO: 7)
MKPGCAAGSPGNEWIFFSTDEITTRYRNTMSNGGLQRSVILSALILLRAV
TGFSGDGRAIWSKNPNFTPVNESQLFLYDTFPKNFFWGIGTGALQVEGSW
KKDGKGPSIWDHFIHTHLKNVSSTNGSSDSYIFLEKDLSALDFIGVSFYQ
FSISWPRLFPDGIVTVANAKGLQYYSTLLDALVLRNIEPIVTLYHWDLPL
ALQEKYGGWKNDTIIDIFNDYATYCFQMFGDRVKYWITIHNPYLVAWHGY
GTGMHAPGEKGNLAAVYTVGHNLIKAHSKVWHNYNTHFRPHQKGWLSITL
GSHWIEPNRSENTMDIFKCQQSMVSVLGWFANPIHGDGDYPEGMRKKLFS
VLPIFSEAEKHEMRGTADFFAFSFGPNNFKPLNTMAKMGQNVSLNLREAL
NWIKLEYNNPRILIAENGWFTDSRVKTEDTTAIYMMKNFLSQVLQAIRLD
EIRVFGYTAWSLLDGFEWQDAYTIRRGLFYVDFNSKQKERKPKSSAHYYK
QIIRENGFSLKESTPDVQGQFPCDFSWGVTESVLKPESVASSPQFSDPHL
YVWNATGNRLLHRVEGVRLKTRPAQCTDFVNIKKQLEMLARMKVTHYRFA
LDWASVLPTGNLSAVNRQALRYYRCVVSEGLKLGISAMVTLYYPTHAHLG
LPEPLLHADGWLNPSTAEAFQAYAGLCFQELGDLVKLWITINEPNRLSDI
YNRSGNDTYGAAHNLLVAHALAWRLYDRQFRPSQRGAVSLSLHADWAEPA
NPYADSHWRAAERFLQFEIAWFAEPLFKTGDYPAAMREYIASKHRRGLSS
SALPRLTEAERRLLKGTVDFCALNHFTTRFVMHEQLAGSRYDSDRDIQFL
QDITRLSSPTRLAVIPWGVRKLLRWVRRNYGDMDIYITASGIDDQALEDD
RLRKYYLGKYLQEVLKAYLIDKVRIKGYYAFKLAEEKSKPRFGFFTSDFK
AKSSIQFYNKVISSRGFPFENSSSRCSQTQENTECTVCLFLVQKKPLIFL
GCCFFSTLVLLLSIAIFQRQKRRKFWKAKNLQHIPLKKGKRVVS.
```

The antigen binding proteins described herein bind the extracellular portion of β-Klotho. An example of an extracellular region of β-Klotho is:

```
                                       (SEQ ID NO: 8.)
MKPGCAAGSPGNEWIFFSTDEITTRYRNTMSNGGLQRSVILSALILLRAV
TGFSGDGRAIWSKNPNFTPVNESQLFLYDTFPKNFFWGIGTGALQVEGSW
KKDGKGPSIWDHFIHTHLKNVSSTNGSSDSYIFLEKDLSALDFIGVSFYQ
```

FSISWPRLFPDGIVTVANAKGLQYYSTLLDALVLRNIEPIVTLYHWDLPL
ALQEKYGGWKNDTIIDIFNDYATYCFQMFGDRVKYWITIHNPYLVAWHGY
GTGMHAPGEKGNLAAVYTVGHNLIKAHSKVWHNYNTHFRPHQKGWLSITL
GSHWIEPNRSENTMDIFKCQQSMVSVLGWFANPIHGDGDYPEGMRKKLFS
VLPIFSEAEKHEMRGTADFFAFSFGPNNFKPLNTMAKMGQNVSLNLREAL
NWIKLEYNNPRILIAENGWFTDSRVKTEDTTAIYMMKNFLSQVLQAIRLD
EIRVFGYTAWSLLDGFEWQDAYTIRRGLFYVDFNSKQKERKPKSSAHYYK
QIIRENGFSLKESTPDVQGQFPCDFSWGVTESVLKPESVASSPQFSDPHL
YVWNATGNRLLHRVEGVRLKTRPAQCTDFVNIKKQLEMLARMKVTHYRFA
LDWASVLPTGNLSAVNRQALRYYRCVVSEGLKLGISAMVTLYYPTHAHLG
LPEPLLHADGWLNPSTAEAFQAYAGLCFQELGDLVKLWITINEPNRLSDI
YNRSGNDTYGAAHNLLVAHALAWRLYDRQFRPSQRGAVSLSLHADWAEPA
NPYADSHWRAAERFLQFEIAWFAEPLFKTGDYPAAMREYIASKHRRGLSS
SALPRLTEAERRLLKGTVDFCALNHFTTRFVMHEQLAGSRYDSDRDIQFL
QDITRLSSPTRLAVIPWGVRKLLRWVRRNYGDMDIYITASGIDDQALEDD
RLRKYYLGKYLQEVLKAYLIDKVRIKGYYAFKLAEEKSKPRFGFFTSDFK
AKSSIQFYNKVISSRGFPPFENSSSRCSQTQENTECTVCLFLVQKKP

The murine form of β-Klotho, and fragments and subsequences thereof, can be of use in studying and/or constructing the molecules provided herein. The nucleotide sequence encoding murine β-Klotho (GenBank™ Accession Number NM_031180) is provided:

(SEQ ID NO: 469)
ATGAAGACAGGCTGTGCAGCAGGGTCTCCGGGGAATGAATGGATTTTCTT
CAGCTCTGATGAAAGAAACACACGCTCTAGGAAAACAATGTCCAACAGGG
CACTGCAAAGATCTGCCGTGCTGTCTGCGTTTGTTCTGCTGCGAGCTGTT
ACCGGCTTCTCCGGAGACGGGAAAGCAATATGGGATAAAAAACAGTACGT
GAGTCCGGTAAACCCAAGTCAGCTGTTCCTCTATGACACTTTCCCTAAAA
ACTTTTCCTGGGGCGTTGGGACCGGAGCATTTCAAGTGGAAGGGAGTTGG
AAGACAGATGGAAGAGGACCCTCGATCTGGGATCGGTACGTCTACTCACA
CCTGAGAGGTGTCAACGGCACAGACAGATCCACTGACAGTTACATCTTTC
TGGAAAAAGACTTGTTGGCTCTGGATTTTTTAGGAGTTTCTTTTTATCAG
TTCTCAATCTCCTGGCCACGGTTGTTTCCCAATGAACAGTAGCAGCAGT
GAATGCGCAAGGTCTCCGGTACTACCGTGCACTTCTGGACTCGCTGGTAC
TTAGGAATATCGAGCCCATTGTTACCTTGTACCATTGGGATTTGCCTCTG
ACGCTCCAGGAAGAATATGGGGCTGGAAAAATGCAACTATGATAGATCT
CTTCAACGACTATGCCACATACTGCTTCCAGACCTTTGGAGACCGTGTCA
AATATTGGATTACAATTCACAACCCTTACCTTGTTGCTTGGCATGGGTTT
GGCACAGGTATGCATGCACCAGGAGAGAAGGGAAATTTAACAGCTGTCTA
CACTGTGGGACACAACCTGATCAAGGCACATTCGAAAGTGTGGCATAACT
ACGACAAAAACTTCCGCCCTCATCAGAAGGGTTGGCTCTCCATCACCTTG
GGGTCCCATTGGATAGAGCCAAACAGAACAGACAACATGGAGGACGTGAT
CAACTGCCAGCACTCCATGTCCTCTGTGCTTGGATGGTTCGCCAACCCCA
TCCACGGGGACGGCGACTACCCTGAGTTCATGAAGACGGGCGCCATGATC
CCCGAGTTCTCTGAGGCAGAGAAGGAGGAGGTGAGGGGCACGGCTGATTT
CTTTGCCTTTTCCTTCGGGCCCAACAACTTCAGGCCCTCAAACACCGTGG
TGAAAATGGGACAAAATGTATCACTCAACTTAAGGCAGGTGCTGAACTGG
ATTAAACTGGAATACGATGACCCTCAAATCTTGATTTCGGAGAACGGCTG
GTTCACAGATAGCTATATAAAGACAGAGGACACCACGGCCATCTACATGA
TGAAGAATTTCCTAAACCAGGTTCTTCAAGCAATAAAATTTGATGAAATC
CGCGTGTTTGGTTATACGGCCTGGACTCTCCTGGATGGCTTTGAGTGGCA
GGATGCCTATACGACCCGACGAGGGCTGTTTTATGTGGACTTTAACAGTG
AGCAGAAAGAGAGGAAACCCAAGTCCTCGGCTCATTACTACAAGCAGATC
ATACAAGACAACGGCTTCCCTTTGAAAGAGTCCACGCCAGACATGAAGGG
TCGGTTCCCCTGTGATTTCTCTTGGGGAGTCACTGAGTCTGTTCTTAAGC
CCGAGTTTACGGTCTCCTCCCCGCAGTTTACCGATCCTCACCTGTATGTG
TGGAATGTCACTGGCAACAGATTGCTCTACCGAGTGGAAGGGGTAAGGCT
GAAAACAAGACCATCCCAGTGCACAGATTATGTGAGCATCAAAAAACGAG
TTGAAATGTTGGCAAAAATGAAAGTCACCCACTACCAGTTTGCTCTGGAC
TGGACCTCTATCCTTCCCACTGGCAATCTGTCCAAAGTTAACAGACAAGT
GTTAAGGTACTATAGGTGTGTGGTGAGCGAAGGACTGAAGCTGGGCGTCT
TCCCCATGGTGACGTTGTACCACCCAACCCACTCCCATCTCGGCCTCCCC
CTGCCACTTCTGAGCAGTGGGGGGTGGCTAAACATGAACACAGCCAAGGC
CTTCCAGGACTACGCTGAGCTGTGCTTCCGGGAGTTGGGGGACTTGGTGA
AGCTCTGGATCACCATCAATGAGCCTAACAGGCTGAGTGACATGTACAAC
CGCACGAGTAATGACACCTACCGTGCAGCCCACAACCTGATGATCGCCCA
TGCCCAGGTCTGGCACCTCTATGATAGGCAGTATAGGCCGGTCCAGCATG
GGGCTGTGTCGCTGTCCTTACATTGCGACTGGGCAGAACCTGCCAACCCC
TTTGTGGATTCACACTGGAAGGCAGCCGAGCGCTTCCTCCAGTTTGAGAT
CGCCTGGTTTGCAGATCCGCTCTTCAAGACTGGCGACTATCCATCGGTTA
TGAAGGAATACATCGCCTCCAAGAACCAGCGAGGGCTGTCTAGCTCAGTC
CTGCCGCGCTTCACCGCGAAGGAGAGCAGGCTGGTGAAGGGTACCGTCGA
CTTCTACGCACTGAACCACTTCACTACGAGGTTCGTGATACACAAGCAGC
TGAACACCAACCGCTCAGTTGCAGACAGGGACGTCCAGTTCCTGCAGGAC
ATCACCCGCCTAAGCTCGCCCAGCCGCCTGGCTGTAACCCCTGGGGAGT
GCGCAAGCTCCTTGCGTGGATCCGGAGGAACTACAGAGACAGGGATATCT
ACATCACAGCCAATGGCATCGATGACCTGGCTCTAGAGGATGATCAGATC
CGAAAGTACTACTTGGAGAAGTATGTCCAGGAGGCTCTGAAAGCATATCT
CATTGACAAGGTCAAAATCAAAGGCTACTATGCATTCAAACTGACTGAAG
AGAAATCTAAGCCTAGATTTGGATTTTTCACCTCTGACTTCAGAGCTAAG
TCCTCTGTCCAGTTTTACAGCAAGCTGATCAGCAGCAGTGGCCTCCCCGC
TGAGAACAGAAGTCCTGCGTGTGGTCAGCCTGCGGAAGACACAGACTGCA

```
CCATTTGCTCATTTCTCGTGGAGAAGAAACCACTCATCTTCTTCGGTTGC

TGCTTCATCTCCACTCTGGCTGTACTGCTATCCATCACCGTTTTTCATCA

TCAAAAGAGAAGAAAATTCCAGAAAGCAAGGAACTTACAAAATATACCAT

TGAAGAAAGGCCACAGCAGAGTTTTCAGCTAA
```

The amino acid sequence of full length murine β-Klotho (GenBank™ Accession Number NP_112457) is provided:

```
                                         (SEQ ID NO: 468)
MKTGCAAGSPGNEWIFFSSDERNTRSRKTMSNRALQRSAVLSAFVLLRA

VTGFSGDGKAIWDKKQYVSPVNPSQLFLYDTFPKNFSWGVGTGAFQVEG

SWKTDGRGPSIWDRYVYSHLRGVNGTDRSTDSYIFLEKDLLALDFLGVSF

YQFSISWPRLFPNGTVAAVNAQGLRYYRALLDSLVLRNIEPIVTLYHWDL

PLTLQEEYGGWKNATMIDLFNDYATYCFQTFGDRVKYWITIHNPYLVAW

HGFGTGMHAPGEKGNLTAVYTVGHNLIKAHSKVWHNYDKNFRPHQKG

WLSITLGSHWIEPNRTDNMEDVINCQHSMSSVLGWFANPIHGDGDYPEF

MKTGAMIPEFSEAEKEEVRGTADFFAFSFGPNNFRPSNTVVKMGQNVSLN

LRQVLNWIKLEYDDPQILISENGWFTDSYIKTEDTTAIYMMKNFLNQVLQ

AIKFDEIRVFGYTAWTLLDGFEWQDAYTTRRGLFYVDFNSEQKERKPKSS

AHYYKQIIQDNGFPLKESTPDMKGRFPCDFSWGVTESVLKPEFTVSSPQF

TDPHLYVWNVTGNRLLYRVEGVRLKTRPSQCTDYVSIKKRVEMLAKMKV

THYQFALDWTSILPTGNLSKVNRQVLRYYRCVVSEGLKLGVFPMVTLYH

PTHSHLGLPLPLLSSGGWLNMNTAKAFQDYAELCFRELGDLVKLWITINE

PNRLSDMYNRTSNDTYRAAHNLMIAHAQVWHLYDRQYRPVQHGAVSLS

LHCDWAEPANPFVDSHWKAAERFLQFEIAWFADPLFKTGDYPSVMKEYI

ASKNQRGLSSSVLPRFTAKESRLVKGTVDFYALNHFTTRFVIHKQLNTNR

SVADRDVQFLQDITRLSSPSRLAVTPWGVRKLLAWIRRNYRDRDIYITAN

GIDDLALEDDQIRKYYLEKYVQEALKAYLIDKVKIKGYYAFKLTEEKSKP

RFGFFTSDFRAKSSVQFYSKLISSSGLPAENRSPACGQPAEDTDCTICSF

LVEKKPLIFFGCCFISTLAVLLSITVFHHQKRRKFQKARNLQNIPLKKGH

SRVFS
```

As described herein, β-Klotho proteins can also include fragments. As used herein, the terms are used interchangeably to mean a co-receptor, in particular and unless otherwise specified, a human co-receptor, that upon association with FGFR1c and FGF21 induces FGF21-like signaling activity.

The term β-Klotho also includes post-translational modifications of the β-Klotho amino acid sequence, for example, possible N-linked glycosylation sites. Thus, the antigen binding proteins can bind to or be generated from proteins glycosylated at one or more of the positions.

Antigen Binding Proteins that Specifically Bind One or More of β-Klotho, FGFR1c, FGFR2c, FGFR3c, FGFR4c A variety of selective binding agents useful for modulating FGF21-like signaling are provided. These agents include, for instance, antigen binding proteins that contain an antigen binding domain (e.g., single chain antibodies, domain antibodies, hemibodies, immunoadhesions, and polypeptides with an antigen binding region) and specifically bind to FGFR1c, β-Klotho or both FGFR1c and β-Klotho, in particular human FGFR1c and human β-Klotho. Some of the agents, for example, are useful in mimicking the signaling effect generated in vivo by the association of FGFR1c with β-Klotho and with FGF21, and can thus be used to enhance or modulate one or more activities associated with FGF21-like signaling.

In general, the antigen binding proteins that are provided typically comprise one or more CDRs as described herein (e.g., 1, 2, 3, 4, 5 or 6 CDRs). In some embodiments the antigen binding proteins are naturally expressed by clones, while in other embodiments, the antigen binding protein can comprise (a) a polypeptide framework structure and (b) one or more CDRs that are inserted into and/or joined to the polypeptide framework structure. In some of these embodiments a CDR forms a component of a heavy or light chains expressed by the clones described herein; in other embodiments a CDR can be inserted into a framework in which the CDR is not naturally expressed. A polypeptide framework structure can take a variety of different forms. For example, a polypeptide framework structure can be, or comprise, the framework of a naturally occurring antibody, or fragment or variant thereof, or it can be completely synthetic in nature. Examples of various antigen binding protein structures are further described below.

In some embodiments in which the antigen binding protein comprises (a) a polypeptide framework structure and (b) one or more CDRs that are inserted into and/or joined to the polypeptide framework structure, the polypeptide framework structure of an antigen binding protein is an antibody or is derived from an antibody, including, but not limited to, monoclonal antibodies, bispecific antibodies, minibodies, domain antibodies, synthetic antibodies (sometimes referred to herein as "antibody mimetics"), chimeric antibodies, humanized antibodies, antibody fusions (sometimes referred to as "antibody conjugates"), and portions or fragments of each, respectively. In some instances, the antigen binding protein is an immunological fragment of an antibody (e.g., a Fab, a Fab', a F(ab')$_2$, or a scFv).

Certain of the antigen binding proteins as provided herein specifically bind to (i) β-Klotho; (ii) FGFR1c, FGFR2c, FGFR3c or FGFR4; or (iii) a complex comprising β-Klotho and one of FGFR1c, FGFR2c, FGFR3c, and FGFR4, including the human forms of these proteins. In one embodiment, an antigen binding protein specifically binds to both human FGFR1c comprising the amino acid sequence of SEQ ID NO:5, and human β-Klotho comprising the amino acid sequence of SEQ ID NO:8, and in another embodiment an antigen binding protein specifically binds to both human FGFR1c comprising the amino acid sequence of SEQ ID NO:5 and human β-Klotho having the amino acid sequence of SEQ ID NO:8 and induces FGF21-like signaling. Thus, an antigen binding protein can, but need not, induce FGF21-like signaling.

Antigen Binding Protein Structure

Some of the antigen binding proteins that specifically bind (i) β-Klotho; (ii) FGFR1c, FGFR2c, FGFR3c or FGFR4; or (iii) a complex comprising β-Klotho and one of FGFR1c, FGFR2c, FGFR3c, and FGFR4, including the human forms of these proteins that are provided herein have a structure typically associated with naturally occurring antibodies. The structural units of these antibodies typically comprise one or more tetramers, each composed of two identical couplets of polypeptide chains, though some species of mammals also produce antibodies having only a single heavy chain. In a typical antibody, each pair or couplet includes one full-length "light" chain (in certain embodiments, about 25 kDa) and one full-length "heavy" chain (in certain embodiments, about 50-70 kDa). Each individual immunoglobulin chain is composed of several "immunoglobulin domains," each consisting of roughly 90 to 110 amino acids and expressing a characteristic folding pattern. These domains are the basic units of which antibody polypeptides are composed. The amino-terminal portion of each chain typically includes a variable domain that is responsible for antigen recognition. The carboxy-terminal portion is more conserved evolutionarily than the other end of the chain and is referred to as the "constant region" or "C region". Human light chains generally are classified as kappa ("κ") and lambda ("λ") light chains, and each of these contains one variable domain and one constant domain. Heavy chains are typically classified as mu, delta, gamma, alpha, or epsilon chains, and these define the antibody's isotype as IgM, IgD, IgG, IgA, and IgE, respectively. IgG has several subtypes, including, but not limited to, IgG1, IgG2, IgG3, and IgG4. IgM subtypes include IgM, and IgM2. IgA subtypes include IgA1 and IgA2. In humans, the IgA and IgD isotypes contain four heavy chains and four light chains; the IgG and IgE isotypes contain two heavy chains and two light chains; and the IgM isotype contains five heavy chains and five light chains. The heavy chain C region typically comprises one or more domains that can be responsible for effector function. The number of heavy chain constant region domains will depend on the isotype. IgG heavy chains, for example, each contain three C region domains known as $C_H1$, $C_H2$ and $C_H3$. The antibodies that are provided can have any of these isotypes and subtypes. In certain embodiments, an antigen binding protein that specifically binds one or more of (i) β-Klotho; (ii) FGFR1c, FGFR2c, FGFR3c or FGFR4; or (iii) a complex comprising β-Klotho and one of FGFR1c, FGFR2c, FGFR3c, and FGFR4 is an antibody of the IgG1, IgG2, or IgG4 subtype.

In full-length light and heavy chains, the variable and constant regions are joined by a "J" region of about twelve or more amino acids, with the heavy chain also including a "D" region of about ten more amino acids. See, e.g., Fundamental Immunology, 2nd ed., Ch. 7 (Paul, W., ed.) 1989, New York: Raven Press (hereby incorporated by reference in its entirety for all purposes). The variable regions of each light/heavy chain pair typically form the antigen binding site.

One example of an IgG2 heavy constant domain of an exemplary monoclonal antibody that specifically binds (i) β-Klotho; (ii) FGFR1c, FGFR2c, FGFR3c or FGFR4; or (iii) a complex comprising β-Klotho and one of FGFR1c, FGFR2c, FGFR3c, and FGFR4 has the amino acid sequence:

```
                                     (SEQ ID NO: 9)
ASTKGPSVFPLAPCSRSTSESTAALGCLVKDYFPEPVTVSWNSGALTSGV

HTFPAVLQSSGLYSLSSVVTVPSSNFGTQTYTCNVDHKPSNTKVDKTVER

KCCVECPPCPAPPVAGPSVFLFPPKPKDTLMISRTPEVTCVVVDVSHEDP

EVQFNWYVDGVEVHNAKTKPREEQFNSTFRVVSVLTVVHQDWLNGKEYK

CKVSNKGLPAPIEKTISKTKGQPREPQVYTLPPSREEMTKNQVSLTCLVK

GFYPSDIAVEWESNGQPENNYKTTPPMLDSDGSFFLYSKLTVDKSRWQQG

NVFSCSVMHEALHNHYTQKSLSLSPGK.
```

One example of a kappa light constant domain of an exemplary monoclonal antibody that binds (i) β-Klotho; (ii) FGFR1c, FGFR2c, FGFR3c or FGFR4; or (iii) a complex comprising β-Klotho and one of FGFR1c, FGFR2c, FGFR3c, and FGFR4 has the amino acid sequence:

```
                                     (SEQ ID NO: 10)
RTVAAPSVFIFPPSDEQLKSGTASVVCLLNNFYPREAKVQWKVDNALQSG

NSQESVTEQDSKDSTYSLSSTLTLSKADYEKHKVYACEVTHQGLSSPVTK

SFNRGEC.
```

One example of a lambda light constant domain of an exemplary monoclonal antibody that binds (i) β-Klotho; (ii) FGFR1c, FGFR2c, FGFR3c or FGFR4; or (iii) a complex comprising β-Klotho and one of FGFR1c, FGFR2c, FGFR3c, and FGFR4 has the amino acid sequence:

```
                                     (SEQ ID NO: 11)
GQPKANPTVTLFPPSSEELQANKATLVCLISDFYPGAVTVAWKADGSPVK

AGVETTKPSKQSNNKYAASSYLSLTPEQWKSHRSYSCQVTHEGSTVEKT

VAPTECS
```

Variable regions of immunoglobulin chains generally exhibit the same overall structure, comprising relatively conserved framework regions (FR) joined by three hypervariable regions, more often called "complementarity determining regions" or CDRs. The CDRs from the two chains of each heavy chain/light chain pair mentioned above typically are aligned by the framework regions to form a structure that binds specifically with a specific epitope on the target protein (e.g., (i) β-Klotho; (ii) FGFR1c, FGFR2c, FGFR3c or FGFR4; or (iii) a complex comprising β-Klotho and one of FGFR1c, FGFR2c, FGFR3c, and FGFR4). From N-terminal to C-terminal, naturally-occurring light and heavy chain variable regions both typically conform with the following order of these elements: FR1, CDR1, FR2, CDR2, FR3, CDR3 and FR4. A numbering system has been devised for assigning numbers to amino acids that occupy positions in each of these domains. This numbering system is defined in Kabat Sequences of Proteins of Immunological Interest (1987 and 1991, NIH, Bethesda, Md.). As desired, the CDRs can also be redefined according an alternative nomenclature scheme, such as that of Chothia (see Chothia & Lesk, 1987, *J. Mol. Biol.* 196:901-917; Chothia et al., 1989, *Nature* 342:878-883 or Honegger & Pluckthun, 2001, *J. Mol. Biol.* 309:657-670.

The various heavy chain and light chain variable regions of antigen binding proteins provided herein are depicted in Table 2. Each of these variable regions can be attached to the above heavy and light chain constant regions to form a complete antibody heavy and light chain, respectively. Further, each of the so-generated heavy and light chain sequences can be combined to form a complete antibody structure. It should be understood that the heavy chain and light chain variable regions provided herein can also be attached to other constant domains having different sequences than the exemplary sequences listed above.

Specific examples of some of the full length light and heavy chains of the antibodies that are provided and their corresponding amino acid sequences are summarized in Tables 1A and 1B. Table 1A shows exemplary light chain sequences, and Table 1B shows exemplary heavy chain sequences.

TABLE 1A

Exemplary Antibody Light Chain Sequences

| SEQ ID NO: | Designation | Contained in Clone | Amino Acid Sequence |
|---|---|---|---|
| 12 | L1 | 17C3 | SYVLTQPPSVSVAPGQTARITCGGNNIGSQSVHWYQ QKPGQAPVLVVYDDSDRPSGIPERFSGSNSGNTATL TISRVEAGDEADYYCQVWDSSSDHVVFGGGTKLTV LGQPKANPTVTLFPPSSEELQANKATLVCLISDFYPG AVTVAWKADGSPVKAGVETTKPSKQSNNKYAASS YLSLTPEQWKSHRSYSCQVTHEGSTVEKTVAPTECS |
| 13 | L2 | 22H5 | SYVLTQPPSVSVAPGQTARITCGGNNIGSQSVHWY QQKPGQAPVLVVYDDSDRPSGIPERFSGSNSGNTAT LTISRVEAGDEADYYCQVWDNTSDHVVFGGGTKL TVLGQPKANPTVTLFPPSSEELQANKATLVCLISDF YPGAVTVAWKADGSPVKAGVETTKPSKQSNNKYA ASSYLSLTPEQWKSHRSYSCQVTHEGSTVEKTVAPT ECS |
| 14 | L3 | 16H7 24H11 | SYVLTQPPSVSVAPGQTARITCGGNNIGSESVHWYQ QKPGQAPVLVVYDDSDRPSGIPERFSGSNSGNTATL TISRVEAGDEADYYCQVWDGNSDHVVFGGGTKLT VLGQPKANPTVTLFPPSSEELQANKATLVCLISDFYP GAVTVAWKADGSPVKAGVETTKPSKQSNNKYAAS SYLSLTPEQWKSHRSYSCQVTHEGSTVEKTVAPTECS |
| 15 | L4 | 18G1 | EIVLTQSPGTLSLSPGERATLSCRASQNFDSSYLAWY QQKPGQAPRLLIYGTSSRATGIPDRFSGIGSGTDFTLT INRLEPEDFAMYYCQQYGGSPLTFGGGTEVEIKRTV AAPSVFIFPPSDEQLKSGTASVVCLLNNFYPREAKVQ WKVDNALQSGNSQESVTEQDSKDSTYSLSSTLTLSK ADYEKHKVYACEVTHQGLSSPVTKSFNRGEC |
| 16 | L5 | 17D8 | EIVLTQSPGTLSLSPGERATLSCRASQSVSGNYLAWY QQKPGQAPRLLIYGASSRATGIPDRFSGSGSGTDFTL TISRLEPEDFAVYYCQQYGSAPLTFGGGTKVEIKRTV AAPSVFIFPPSDEQLKSGTASVVCLLNNFYPREAKVQ WKVDNALQSGNSQESVTEQDSKDSTYSLSSTLTLSK ADYEKHKVYACEVTHQGLSSPVTKSFNRGEC |
| 17 | L6 | 26H11 | EIVLTQSPGTLSLSPGERATLSCRASQSVSGNYLAW YQQKPGQAPRLLIYGASSRATGIPDRFSGSGSGTDF TLTISRLEPEDFAMYYCQQYGSSPLTFGGGSKVEIK RTVAAPSVFIFPPSDEQLKSGTASVVCLLNNFYPRE AKVQWKVDNALQSGNSQESVTEQDSKDSTYSLSST LTLSKADYEKHKVYACEVTHQGLSSPVTKSFNRGEC |
| 18 | L7 | 12E4 | EIVLTQSPGTLSLSPGERATLSCRASQNFDSNYLAWY QQKPGQAPRLLIYGASSRATGIPDNFSGSGSGTDFTL TISRLEPEDFAMYYCQQYGSSPLTFGGGTKVEIKRTV AAPSVFIFPPSDEQLKSGTASVVCLLNNFYPREAKVQ WKVDNALQSGNSQESVTEQDSKDSTYSLSSTLTLSK ADYEKHKVYACEVTHQGLSSPVTKSFNRGEC |
| 19 | L8 | 12C11 | EIVLTQSPGTLSLSPGERATLSCRASQNFDSSSLAWY QQKPGQAPRLLIYGASSRATGIPDRFSGSGSGTDFTL TISRLEPEDFAMYYCQQCGSSPLTFGGGTKVEIKRTV AAPSVFIFPPSDEQLKSGTASVVCLLNNFYPREAKVQ WKVDNALQSGNSQESVTEQDSKDSTYSLSSTLTLSK ADYEKHKVYACEVTHQGLSSPVTKSFNRGEC |
| 20 | L9 | 21H2 21B4 | EIVLTQSPGTLSLSPGERATLSCRASQSVSSTYLAWH QQKPGQGLRLLIYGASSRATGIPDRFSGSGSGTDFTL TISRLEPEDFAVYYCQQYGSSFTFGGGTRVEIKRTVA APSVFIFPPSDEQLKSGTASVVCLLNNFYPREAKVQ WKVDNALQSGNSQESVTEQDSKDSTYSLSSTLTLSK ADYEKHKVYACEVTHQGLSSPVTKSFNRGEC |
| 21 | L10 | 18B11.1 | DIVMTQSPLSLPVTPGEPASISCRSSQSLLYYNGFTYL DWFLQKPGQSPHLLIYLGSNRASGVPDRFSGSVSGT DFTLKISRVEAEDVGVYYCMQSLQTPFTFGPGTKVD IKRTVAAPSVFIFPPSDEQLKSGTASVVCLLNNFYPR EAKVQWKVDNALQSGNSQESVTEQDSKDSTYSLSS TLTLSKADYEKHKVYACEVTHQGLSSPVTKSFNRGEC |
| 22 | L11 | 18B11.2 | EIVMTQSPATLSVSPGERATLSCRASQSVNSNLAWY QQKPGQAPRLLIYGVSTRATGIPARFSGSGSGTEFTL TIRSLQSEDFAVYYCQQYNNWPPTFGQGTKVEIKRT |

TABLE 1A-continued

Exemplary Antibody Light Chain Sequences

| SEQ ID NO: | Designation | Contained in Clone | Amino Acid Sequence |
|---|---|---|---|
| | | | VAAPSVFIFPPSDEQLKSGTASVVCLLNNFYPREAKV QWKVDNALQSGNSQESVTEQDSKDSTYSLSSTLTLS KADYEKHKVYACEVTHQGLSSPVTKSFNRGEC |
| 23 | L12 | 20D4 | DIQLTQSPSSLSASIGDRVTITCRASQDIRYDLGWYQ QKPGKAPKRLIYAASSLQSGVPSRFSGSGSGTEFTLT VSSLQPEDFATYYCLQHNSYPLTFGGGTKVEIERTV AAPSVFIFPPSDEQLKSGTASVVCLLNNFYPREAKVQ WKVDNALQSGNSQESVTEQDSKDSTYSLSSTLTLSK ADYEKHKVYACEVTHQGLSSPVTKSFNRGEC |
| 24 | L13 | 46D11 | DIQMTQSPSSVSASVGDRVTITCRASQGISIWLAWYQ QKPGKAPKLLIYAASSLQSGVPSRFSGSGSGTDFTLTI SSLQPEDFATYYCQQANDFPITFGQGTRLEIKRTVAA PSVFIFPPSDEQLKSGTASVVCLLNNFYPREAKVQW KVDNALQSGNSQESVTEQDSKDSTYSLSSTLTLSKA DYEKHKVYACEVTHQGLSSPVTKSFNRGEC |
| 25 | L14 | 40D2 | DFVMTQTPLSLSVTPGQPASISCKSSQSLLQSDGKTY LYWYLQKPGQPPHLLIYEVSNRFSGVPDRFSGSGSG TDFTLKISRVEAEDVGVYYCMQSIQLPRTFGQGTKV EIKRTVAAPSVFIFPPSDEQLKSGTASVVCLLNNFYP REAKVQWKVDNALQSGNSQESVTEQDSKDSTYSLS STLTLSKADYEKHKVYACEVTHQGLSSPVTKSFNRG EC |
| 26 | L15 | 37D3 | DIVMTQSPLSLPVTPGEPASISCRSSQSLLHSNGYNFL DWYLQKPGQSPQLLIYLGSDRASGVPDRFSGSGSGT EFTLKISRVEAEDVGLYYCMQALQTPCSFGQGTKLE IKRTVAAPSVFIFPPSDEQLKSGTASVVCLLNNFYPR EAKVQWKVDNALQSGNSQESVTEQDSKDSTYSLSS TLTLSKADYEKHKVYACEVTHQGLSSPVTKSFNRGEC |
| 27 | L16 | 39F7 | EIVLTQSPGTLSLSPGERATLSCRASQSVSSTYLAWY QQKPGQAPRLLIYGASSRATGIPDRFSGSGSGTDFTL TISRLEPEDFAVYYCQQSGSSPLTFGGGTEVEIKRTV AAPSVFIFPPSDEQLKSGTASVVCLLNNFYPREAKVQ WKVDNALQSGNSQESVTEQDSKDSTYSLSSTLTLSK ADYEKHKVYACEVTHQGLSSPVTKSFNRGEC |
| 28 | L17 | 39F11 | EIVLTQSPGTLSLSPGERATLSCRASQSVSSTYLAWY QQKPGQAPSLLIYGASSRATGIPDRFSGSGSGTDFTL TISRLEPEDFAVYYCQQSGSSPLTFGGGTKVEIKRTV AAPSVFIFPPSDEQLKSGTASVVCLLNNFYPREAKVQ WKVDNALQSGNSQESVTEQDSKDSTYSLSSTLTLSK ADYEKHKVYACEVTHQGLSSPVTKSFNRGEC |
| 29 | L18 | 39G5 | EIVLTQSPGTLSLSPGERATLSCRASQSVSSTYLAWY QQKPGQAPRLLIYGASFRATGIPDRFSGSGSGTDFTL TISRLEPEDFAVYYCQQSGSSPLTFGGGTKVEIKRTV AAPSVFIFPPSDEQLKSGTASVVCLLNNFYPREAKVQ WKVDNALQSGNSQESVTEQDSKDSTYSLSSTLTLSK ADYEKHKVYACEVTHQGLSSPVTKSFNRGEC |

TABLE 1B

Exemplary Antibody Heavy Chain Sequences

| SEQ ID NO: | Designation | Contained in Clone | Sequence |
|---|---|---|---|
| 30 | H1 | 17C3 | QVTLKESGPVLVKPTETLTLTCTVSGFSLSNARMG VSWIRQPPGKALEWLAHIFSNDEKSYSTSLKSRLTI SKDTSKSQVVLTMTNMDPVDTATYYCARILLLGA YYYYGMDVWGQGTTVTVSSASTKGPSVFPLAPCS RSTSESTAALGCLVKDYFPEPVTVSWNSGALTSGV HTFPAVLQSSGLYSLSSVVTVPSSNFGTQTYTCNV DHKPSNTKVDKTVERKCCVECPPCPAPPVAGPSVF LFPPKPKDTLMISRTPEVTCVVVDVSHEDPEVQFN WYVDGVEVHNAKTKPREEQFNSTFRVVSVLTVVH QDWLNGKEYKCKVSNKGLPAPIEKTISKTKGQPRE |

TABLE 1B-continued

Exemplary Antibody Heavy Chain Sequences

| SEQ ID NO: | Designation | Contained in Clone | Sequence |
|---|---|---|---|
| | | | PQVYTLPPSREEMTKNQVSLTCLVKGFYPSDIAVE WESNGQPENNYKTTPPMLDSDGSFFLYSKLTVDK SRWQQGNVFSCSVMHEALHNHYTQKSLSLSPGK |
| 31 | H2 | 22H5 | QVTLKESGPVLVKPTETLTLTCTVSGFSLSNARMG VSWIRQPPGKALEWLAHIFSNDEKSYSTSLKSRLTI SKDTSKSQVVLTMTNMDPVDTATYYCARILLVGA YYYCGMDVWGQGTTVTVSSASTKGPSVFPLAPCS RSTSESTAALGCLVKDYFPEPVTVSWNSGALTSGV HTFPAVLQSSGLYSLSSVVTVPSSNFGTQTYTCNV DHKPSNTKVDKTVERKCCVECPPCPAPPVAGPSVF LFPPKPKDTLMISRTPEVTCVVVDVSHEDPEVQFN WYVDGVEVHNAKTKPREEQFNSTFRVVSVLTVVH QDWLNGKEYKCKVSNKGLPAPIEKTISKTKGQPRE PQVYTLPPSREEMTKNQVSLTCLVKGFYPSDIAVE WESNGQPENNYKTTPPMLDSDGSFFLYSKLTVDK SRWQQGNVFSCSVMHEALHNHYTQKSLSLSPGK |
| 32 | H3 | 16H7 | QVTLKESGPVLVKPTETLTLTCTVSGFSLNNARMG VSWIRQPPGKALEWLAHIFSNDEKSYSTSLKSRLTI SKDTSKSQVVLIMTNMDPVDTATYYCARSVVTGG YYYDGMDVWGQGTTVTVSSASTKGPSVFPLAPCS RSTSESTAALGCLVKDYFPEPVTVSWNSGALTSGV HTFPAVLQSSGLYSLSSVVTVPSSNFGTQTYTCNV DHKPSNTKVDKTVERKCCVECPPCPAPPVAGPSVF LFPPKPKDTLMISRTPEVTCVVVDVSHEDPEVQFN WYVDGVEVHNAKTKPREEQFNSTFRVVSVLTVVH QDWLNGKEYKCKVSNKGLPAPIEKTISKTKGQPRE PQVYTLPPSREEMTKNQVSLTCLVKGFYPSDIAVE WESNGQPENNYKTTPPMLDSDGSFFLYSKLTVDK SRWQQGNVFSCSVMHEALHNHYTQKSLSLSPGK |
| 33 | H4 | 24H11 | QVTLKESGPVLVKPTETLTLTCTVSGFSLSNARMG VSWIRQPPGKALEWLAHIFSNDEKSYSTSLKNRLTI SKDTSKSQVVLIMTNMDPVDTATYYCARSVVTGG YYYDGMDVWGQGTTVTVSSASTKGPSVFPLAPCS RSTSESTAALGCLVKDYFPEPVTVSWNSGALTSGV HTFPAVLQSSGLYSLSSVVTVPSSNFGTQTYTCNV DHKPSNTKVDKTVERKCCVECPPCPAPPVAGPSVF LFPPKPKDTLMISRTPEVTCVVVDVSHEDPEVQFN WYVDGVEVHNAKTKPREEQFNSTFRVVSVLTVVH QDWLNGKEYKCKVSNKGLPAPIEKTISKTKGQPRE PQVYTLPPSREEMTKNQVSLTCLVKGFYPSDIAVE WESNGQPENNYKTTPPMLDSDGSFFLYSKLTVDK SRWQQGNVFSCSVMHEALHNHYTQKSLSLSPGK |
| 34 | H5 | 18G1 | EVQLLESGGGLVQPGGSLRLSCAASRFTFSTYAMS WVRQAPGKGLEWVSGISGSGVSTHYADSVKGRFT ISRDNSKNTLYLQMNSLRAEDTAVYYCAKSLIVVI VYALDHWGQGTLVTVSSASTKGPSVFPLAPCSRST SESTAALGCLVKDYFPEPVTVSWNSGALTSGVHTF PAVLQSSGLYSLSSVVTVPSSNFGTQTYTCNVDHK PSNTKVDKTVERKCCVECPPCPAPPVAGPSVFLFPP KPKDTLMISRTPEVTCVVVDVSHEDPEVQFNWYV DGVEVHNAKTKPREEQFNSTFRVVSVLTVVHQDW LNGKEYKCKVSNKGLPAPIEKTISKTKGQPREPQV YTLPPSREEMTKNQVSLTCLVKGFYPSDIAVEWES NGQPENNYKTTPPMLDSDGSFFLYSKLTVDKSRW QQGNVFSCSVMHEALHNHYTQKSLSLSPGK |
| 35 | H6 | 17D8 | EVQLLESGGGLVQPGGYLRLSCAASGFTFSTYAMS WVRQAPGKGLEWVSAISGSGVSTYYADSVKGRFT ISRDNSKNTLYLQMNSLRAEDTAVYYCAKSLIVV MVYVLDYWGQGTLVTVSSASTKGPSVFPLAPCSR STSESTAALGCLVKDYFPEPVTVSWNSGALTSGVH TFPAVLQSSGLYSLSSVVTVPSSNFGTQTYTCNVD HKPSNTKVDKTVERKCCVECPPCPAPPVAGPSVFL FPPKPKDTLMISRTPEVTCVVVDVSHEDPEVQFNW YVDGVEVHNAKTKPREEQFNSTFRVVSVLTVVHQ DWLNGKEYKCKVSNKGLPAPIEKTISKTKGQPREP QVYTLPPSREEMTKNQVSLTCLVKGFYPSDIAVEW ESNGQPENNYKTTPPMLDSDGSFFLYSKLTVDKSR WQQGNVFSCSVMHEALHNHYTQKSLSLSPGK |

TABLE 1B-continued

Exemplary Antibody Heavy Chain Sequences

| SEQ ID NO: | Designation | Contained in Clone | Sequence |
|---|---|---|---|
| 36 | H7 | 26H11 | EVQLLESGGGLVQPGGYLRLSCAASGFTFSTYAMSWVRQAPGKGLEWVSAISGSGVSTNYADSVKGRFTISRDNSKNTLYLQMNSLRAEDTAVYYCAKSLIVVMVYVLDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK |
| 37 | H8 | 12E4<br>12C11 | EVQLLESGGGLVQPGGSLRLSCAASRFTFSTYAMSWVRQAPGKGLEWVSGISGSGVSTYYADSVKGRFTISRDNSKNTLYLQMNSLRAEDTAVYYCAKSLIVVIVYALDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK |
| 38 | H9 | 21H2 | QVQLQESGPGLVKPSETLSLTCTVSGGSISSYYWSWIRQPAGKGLEWIGRIYTSGSTNYNPSLKSRVTMSKDTSKNQFSLKLRSVTAADTAVYYCARDPDGDYYYYGMDVWGQGTSVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK |
| 39 | H10 | 21B4 | QVQLQESGPGLVKPSETLSLTCTVSGGSISSYFWSWIRQPAGKGLEWIGRIYTSGSTNYNPSLKSRVTMSIDTSKNQFSLKLSSVTAADTAVYYCARDPDGDYYYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK |
| 40 | H11 | 18B11.1<br>18B11.2 | EVQLVESGGGLVKPGGSLRLSCAASGFTFSDAWMSWVRQAPGKGLEWVGRIKSKTDGGTTDYAAPVKGRFTISRDDSKNTLYLQMNSLKTEDTAVYFCTSTYSSGWYVWDYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK |
| 41 | H12 | 20D4 | QVQLVQSGAEVKKPGASVKVSCKVSGYTLTDLSMHWVRQAPGKGLEWMGGFDPEDGETIYAQKFQGRITMTEDTSTDTAYMELSSLRSEDTAVYYCASIVVVP |

TABLE 1B-continued

Exemplary Antibody Heavy Chain Sequences

| SEQ ID NO: | Designation | Contained in Clone | Sequence |
|---|---|---|---|
| | | | AAIQSYYYYGMGVWGQGTTVTSSASTKGPSVF PLAPCSRSTSESTAALGCLVKDYFPEPVTVSWNSG ALTSGVHTFPAVLQSSGLYSLSSVVTVPSSNFGTQT YTCNVDHKPSNTKVDKTVERKCCVECPPCPAPPV AGPSVFLFPPKPKDTLMISRTPEVTCVVVDVSHEDP EVQFNWYVDGVEVHNAKTKPREEQFNSTFRVVSV LTVVHQDWLNGKEYKCKVSNKGLPAPIEKTISKT KGQPREPQVYTLPPSREEMTKNQVSLTCLVKGFYP SDIAVEWESNGQPENNYKTTPPMLDSDGSFFLYSK LTVDKSRWQQGNVFSCSVMHEALHNHYTQKSLSL SPGK |
| 42 | H13 | 46D11 | QVTLKEAGPVLVKPTETLTLTCTVSGFSLSNARMG VNWIRQPPGKALEWLAHIFSNDEKSYSTSLKSRLTI SKDTSKSQVVLTMTNMDPVDTATYYCARVRIAGD YYYYYGMDVWGQGTTVTVSSASTKGPSVFPLAPC SRSTSESTAALGCLVKDYFPEPVTVSWNSGALTSG VHTFPAVLQSSGLYSLSSVVTVPSSNFGTQTYTCN VDHKPSNTKVDKTVERKCCVECPPCPAPPVAGPSV FLFPPKPKDTLMISRTPEVTCVVVDVSHEDPEVQF NWYVDGVEVHNAKTKPREEQFNSTFRVVSVLTVV HQDWLNGKEYKCKVSNKGLPAPIEKTISKTKGQP REPQVYTLPPSREEMTKNQVSLTCLVKGFYPSDIA VEWESNGQPENNYKTTPPMLDSDGSFFLYSKLTV DKSRWQQGNVFSCSVMHEALHNHYTQKSLSLSPGK |
| 43 | H14 | 39F11 | QVQLVESGGGVVQPGRSLRLSCAASGFTFSSYGIH WVRQAPGKGLEWVAVIWYDGSDKYYADSVKGR FTISRDNSKNTLYLQMNSLRAEDTAVYYCARDRA AAGLHYYYGMDVWGQGTTVTVSSASTKGPSVFP LAPCSRSTSESTAALGCLVKDYFPEPVTVSWNSGA LTSGVHTFPAVLQSSGLYSLSSVVTVPSSNFGTQTY TCNVDHKPSNTKVDKTVERKCCVECPPCPAPPVA GPSVFLFPPKPKDTLMISRTPEVTCVVVDVSHEDPE VQFNWYVDGVEVHNAKTKPREEQFNSTFRVVSVL TVVHQDWLNGKEYKCKVSNKGLPAPIEKTISKTK GQPREPQVYTLPPSREEMTKNQVSLTCLVKGFYPS DIAVEWESNGQPENNYKTTPPMLDSDGSFFLYSKL TVDKSRWQQGNVFSCSVMHEALHNHYTQKSLSLS PGK |
| 44 | H15 | 39F7 | QVQLVESGGGVVQPGRSLRLSCAASGFTFSNYGIH WVRQAPGKGLEWVAVIWYDGSIKYYADSVKGRF TISRDNSKNTLYLQMNSLRAEDTAVYYCARDRAA AGLHYYYGMDVWGQGTTVTVSSASTKGPSVFPL APCSRSTSESTAALGCLVKDYFPEPVTVSWNSGAL TSGVHTFPAVLQSSGLYSLSSVVTVPSSNFGTQTYT CNVDHKPSNTKVDKTVERKCCVECPPCPAPPVAG PSVFLFPPKPKDTLMISRTPEVTCVVVDVSHEDPEV QFNWYVDGVEVHNAKTKPREEQFNSTFRVVSVLT VVHQDWLNGKEYKCKVSNKGLPAPIEKTISKTKG QPREPQVYTLPPSREEMTKNQVSLTCLVKGFYPSD IAVEWESNGQPENNYKTTPPMLDSDGSFFLYSKLT VDKSRWQQGNVFSCSVMHEALHNHYTQKSLSLSP GK |
| 45 | H16 | 39G5 | QVQLVESGGGVVQPGRSLRLSCAVSGFTFSSYGIH WVRQAPGKGLEWVAVIWYDGSDKYYGDSVKGR FTISRDNSKNTLYLQMNSLRAEDTAVYYCARDRA AAGLHYYYGMDVWGQGTTVTVSSASTKGPSVFP LAPCSRSTSESTAALGCLVKDYFPEPVTVSWNSGA LTSGVHTFPAVLQSSGLYSLSSVVTVPSSNFGTQTY TCNVDHKPSNTKVDKTVERKCCVECPPCPAPPVA GPSVFLFPPKPKDTLMISRTPEVTCVVVDVSHEDPE VQFNWYVDGVEVHNAKTKPREEQFNSTFRVVSVL TVVHQDWLNGKEYKCKVSNKGLPAPIEKTISKTK GQPREPQVYTLPPSREEMTKNQVSLTCLVKGFYPS DIAVEWESNGQPENNYKTTPPMLDSDGSFFLYSKL TVDKSRWQQGNVFSCSVMHEALHNHYTQKSLSLS PGK |
| 46 | H17 | 40D2 | QVQLQESGPGLVKPSQTLSLTCTVSGGSISSGGYN WSWIRQHPGKGLEWIGNIYYSGSTYYNPSLKSRVT ISVDTSKNQFSLKLRSVTAADTAVYYCARENIVVIP AAIFAGWFDPWGQGTLVTVSSASTKGPSVFPLAPC |

TABLE 1B-continued

Exemplary Antibody Heavy Chain Sequences

| SEQ ID NO: | Designation | Contained in Clone | Sequence |
|---|---|---|---|
| | | | SRSTSESTAALGCLVKDYFPEPVTVSWNSGALTSG VHTFPAVLQSSGLYSLSSVVTVPSSNFGTQTYTCN VDHKPSNTKVDKTVERKCCVECPPCPAPPVAGPSV FLFPPKPKDTLMISRTPEVTCVVVDVSHEDPEVQF NWYVDGVEVHNAKTKPREEQFNSTFRVVSVLTVV HQDWLNGKEYKCKVSNKGLPAPIEKTISKTKGQP REPQVYTLPPSREEMTKNQVSLTCLVKGFYPSDIA VEWESNGQPENNYKTTPPMLDSDGSFFLYSKLTV DKSRWQQGNVFSCSVMHEALHNHYTQKSLSLSPGK |
| 47 | H18 | 37D3 | EVHLVESGGGLAKPGGSLRLSCAASGFTFRNAWM SWVRQAPGKGLEWVGRIKSKTDGGTTDYAAPVK GRFTISRDDSKNTLYLQMNSLKTEDTAEYYCITDR VLSYYAMAVWGQGTTVTVSSASTKGPSVFPLAPC SRSTSESTAALGCLVKDYFPEPVTVSWNSGALTSG VHTFPAVLQSSGLYSLSSVVTVPSSNFGTQTYTCN VDHKPSNTKVDKTVERKCCVECPPCPAPPVAGPSV FLFPPKPKDTLMISRTPEVTCVVVDVSHEDPEVQF NWYVDGVEVHNAKTKPREEQFNSTFRVVSVLTVV HQDWLNGKEYKCKVSNKGLPAPIEKTISKTKGQP REPQVYTLPPSREEMTKNQVSLTCLVKGFYPSDIA VEWESNGQPENNYKTTPPMLDSDGSFFLYSKLTV DKSRWQQGNVFSCSVMHEALHNHYTQKSLSLSPGK |

Again, each of the exemplary heavy chains (H1, H2, H3 etc.) listed in Table 1B and 6A, infra, can be combined with any of the exemplary light chains shown in Table 1A and 6A, infra, to form an antibody. Examples of such combinations include H1 combined with any of L1 through L18; H2 combined with any of L1 through L18; H3 combined with any of L1 through L18, and so on. In some instances, the antibodies include at least one heavy chain and one light chain from those listed in Tables 1A and 1B and 6A, infra; particular examples pairings of light chains and heavy chains include L1 with H1, L2 with H2, L3 with H3, L4 with H4, L5 with H5, L6 with H6, L7 with H7, L8 with H8, L9 with H9, L10 with H10, L11 with H11, L12 with H12, L13 with H13, L14 with H14, L15 with H15, L16 with H16, L17 with H17, and L18 with H18. In addition to antigen binding proteins comprising a heavy and a light chain from the same clone, a heavy chain from a first clone can be paired with a light chain from a second clone (e.g., a heavy chain from 46D11 paired with a light chain from 16H7 or a heavy chain from 16H7 paired with a light chain from 46D11). Generally, such pairings can include VL with 90% or greater homology can be paired with the heavy chain of the naturally occurring clone. In some instances, the antibodies comprise two different heavy chains and two different light chains listed in Tables 1A and 1B and 6A, infra. In other instances, the antibodies contain two identical light chains and two identical heavy chains. As an example, an antibody or immunologically functional fragment can include two H1 heavy chains and two L1 light chains, or two H2 heavy chains and two L2 light chains, or two H3 heavy chains and two L3 light chains and other similar combinations of pairs of light chains and pairs of heavy chains as listed in Tables 1A and 1B and 6A, infra.

In another aspect of the instant disclosure, "hemibodies" are provided. A hemibody is a monovalent antigen binding protein comprising (i) an intact light chain, and (ii) a heavy chain fused to an Fc region (e.g., an IgG2 Fc region of SEQ ID NO:441), optionally via a linker, The linker can be a $(G_4S)_x$ linker where "x" is a non-zero integer (e.g., $(G_4S)_8$; SEQ ID NO:440). Hemibodies can be constructed using the provided heavy and light chain components. Specific examples of hemibodies are disclosed in Example 14.

Other antigen binding proteins that are provided are variants of antibodies formed by combination of the heavy and light chains shown in Tables 1A and 1B and 6A, infra and comprise light and/or heavy chains that each have at least 70%, 75%, 80%, 85%, 90%, 95%, 96%, 97%, 98% or 99% identity to the amino acid sequences of these chains. In some instances, such antibodies include at least one heavy chain and one light chain, whereas in other instances the variant forms contain two identical light chains and two identical heavy chains.

Variable Domains of Antigen Binding Proteins

Also provided are antigen binding proteins that contain an antibody heavy chain variable region selected from the group consisting of $V_H1$, $V_H2$, $V_H3$, $V_H4$, $V_H5$, $V_H6$, $V_H7$, $V_H8$, $V_H9$, $V_H10$, $V_H11$, $V_H12$, $V_H13$, $V_H14$, $V_H15$, $V_H16$, $V_H17$ and $V_H18$ as shown in Table 2B and/or an antibody light chain variable region selected from the group consisting of $V_L1$, $V_L2$, $V_L3$, $V_L4$, $V_L5$, $V_L6$, $V_L7$, $V_L8$, $V_L9$, $V_L10$, $V_L11$, $V_L12$, $V_L13$, $V_L14$, $V_L15$, $V_L16$, $V_L17$ and $V_L18$ as shown in Table 2A, and immunologically functional fragments, derivatives, muteins and variants of these light chain and heavy chain variable regions.

TABLE 2A

Exemplary Antibody Variable Light ($V_L$) Chains

| Contained in Clone | Designation | SEQ ID NO. | Amino Acid Sequence |
|---|---|---|---|
| 17C3 | $V_L1$ | 48 | SYVLTQPPSVSVAPGQTARITCGGNNIGSQSVHWY QQKPGQAPVLVVYDDSDRPSGIPERFSGSNSGNTA |

TABLE 2A-continued

Exemplary Antibody Variable Light (V_L) Chains

| Contained in Clone | Designation | SEQ ID NO. | Amino Acid Sequence |
|---|---|---|---|
| | | | TLTISRVEAGDEADYYCQVWDSSSDHVVFGGGTK LTVL |
| 22H5 | V_L2 | 49 | SYVLTQPPSVSVAPGQTARITCGGNNIGSQSVHWY QQKPGQAPVLVVYDDSDRPSGIPERFSGSNSGNTA TLTISRVEAGDEADYYCQVWDNTSDHVVFGGGTK LTVL |
| 16H7 24H11 | V_L3 | 50 | SYVLTQPPSVSVAPGQTARITCGGNNIGSESVHWY QQKPGQAPVLVVYDDSDRPSGIPERFSGSNSGNTA TLTISRVEAGDEADYYCQVWDGNSDHVVFGGGT KLTVL |
| 18G1 | V_L4 | 51 | EIVLTQSPGTLSLSPGERATLSCRASQNFDSSYLAW YQQKPGQAPRLLIYGTSSRATGIPDRFSGIGSGTDF TLTINRLEPEDFAMYYCQQYGGSPLTFGGGTEVEIK |
| 17D8 | V_L5 | 52 | EIVLTQSPGTLSLSPGERATLSCRASQSVSGNYLA WYQQKPGQAPRLLIYGASSRATGIPDRFSGSGSGT DFTLTISRLEPEDFAVYYCQQYGSAPLTFGGGTKV EIK |
| 26H11 | V_L6 | 53 | EIVLTQSPGTLSLSPGERATLSCRASQSVSGNYLA WYQQKPGQAPRLLIYGASSRATGIPDRFSGSGSGT DFTLTISRLEPEDFAMYYCQQYGSSPLTFGGGSKV EIK |
| 12E4 | V_L7 | 54 | EIVLTQSPGTLSLSPGERATLSCRASQNFDSNYLA WYQQKPGQAPRLLIYGASSRATGIPDNFSGSGSGT DFTLTISRLEPEDFAMYYCQQYGSSPLTFGGGTKV EIK |
| 12C11 | V_L8 | 55 | EIVLTQSPGTLSLSPGERATLSCRASQNFDSSSLAW YQQKPGQAPRLLIYGASSRATGIPDRFSGSGSGTDF TLTISRLEPEDFAMYYCQQCGSSPLTFGGGTKVEIK |
| 21H2 21B4 | V_L9 | 56 | EIVLTQSPGTLSLSPGERATLSCRASQSVSSTYLAW HQQKPGQGLRLLIYGASSRATGIPDRFSGSGSGTDF TLTISRLEPEDFAVYYCQQYGSSFTFGGGTRVEIK |
| 18B11.1 | V_L10 | 57 | DIVMTQSPLSLPVTPGEPASISCRSSQSLLYYNGFT YLDWFLQKPGQSPHLLIYLGSNRASGVPDRFSGSV SGTDFTLKISRVEAEDVGVYYCMQSLQTPFTFGPG TKVDIK |
| 18B11.2 | V_L11 | 58 | EIVMTQSPATLSVSPGERATLSCRASQSVNSNLAW YQQKPGQAPRLLIYGVSTRATGIPARFSGSGSGTEF TLTIRSLQSEDFAVYYCQQYNNWPPTFGQGTKVEIK |
| 20D4 | V_L12 | 59 | DIQLTQSPSSLSASIGDRVTITCRASQDIRYDLGWY QQKPGKAPKRLIYAASSLQSGVPSRFSGSGSGTEFT LTVSSLQPEDFATYYCLQHNSYPLTFGGGTKVEIE |
| 46D11 | V_L13 | 60 | DIQMTQSPSSVSASVGDRVTITCRASQGISIWLAW YQQKPGKAPKLLIYAASSLQSGVPSRFSGSGSGTD FTLTISSLQPEDFATYYCQQANDFPITFGQGTRLEIK |
| 40D2 | V_L14 | 61 | DFVMTQTPLSLSVTPGQPASISCKSSQSLLQSDGKT YLYWYLQKPGQPPHLLIYEVSNRFSGVPDRFSGSG SGTDFTLKISRVEAEDVGVYYCMQSIQLPRTFGQG TKVEIK |
| 37D3 | V_L15 | 62 | DIVMTQSPLSLPVTPGEPASISCRSSQSLLHSNGYN FLDWYLQKPGQSPQLLIYLGSDRASGVPDRFSGSG SGTEFTLKISRVEAEDVGLYYCMQALQTPCSFGQG TKLEIK |
| 39F7 | V_L16 | 63 | EIVLTQSPGTLSLSPGERATLSCRASQSVSSTYLAW YQQKPGQAPRLLIYGASSRATGIPDRFSGSGSGTDF TLTISRLEPEDFAVYYCQQSGSSPLTFGGGTEVEIK |
| 39F11 | V_L17 | 64 | EIVLTQSPGTLSLSPGERATLSCRASQSVSSTYLAW YQQKPGQAPSLLIYGASSRATGIPDRFSGSGSGTDF TLTISRLEPEDFAVYYCQQSGSSPLTFGGGTKVEIK |

TABLE 2A-continued

Exemplary Antibody Variable Light (V$_L$) Chains

| Contained in Clone | Designation | SEQ ID NO. | Amino Acid Sequence |
|---|---|---|---|
| 39G5 | V$_L$18 | 65 | EIVLTQSPGTLSLSPGERATLSCRASQSVSSTYLAW YQQKPGQAPRLLIYGASFRATGIPDRFSGSGSGTDF TLTISRLEPEDFAVYYCQQSGSSPLTFGGGTKVEIK |

TABLE 2B

Exemplary Antibody Variable Heavy (V$_H$) Chains

| Contained in Clone | Designation | SEQ ID NO. | Amino Acid Sequence |
|---|---|---|---|
| 17C3 | V$_H$1 | 66 | QVTLKESGPVLVKPTETLTLTCTVSGFSLSNARMG VSWIRQPPGKALEWLAHIFSNDEKSYSTSLKSRLTI SKDTSKSQVVLTMTNMDPVDTATYYCARILLLGA YYYYGMDVWGQGTTVTVSS |
| 22H5 | V$_H$2 | 67 | QVTLKESGPVLVKPTETLTLTCTVSGFSLSNARMG VSWIRQPPGKALEWLAHIFSNDEKSYSTSLKSRLTI SKDTSKSQVVLTMTNMDPVDTATYYCARILLVGA YYYCGMDVWGQGTTVTVSS |
| 16H7 | V$_H$3 | 68 | QVTLKESGPVLVKPTETLTLTCTVSGFSLNNARMG VSWIRQPPGKALEWLAHIFSNDEKSYSTSLKSRLTI SKDTSKSQVVLIMTNMDPVDTATYYCARSVVTGG YYYDGMDVWGQGTTVTVSS |
| 24H11 | V$_H$4 | 69 | QVTLKESGPVLVKPTETLTLTCTVSGFSLSNARMG VSWIRQPPGKALEWLAHIFSNDEKSYSTSLKNRLTI SKDTSKSQVVLIMTNMDPVDTATYYCARSVVTGG YYYDGMDVWGQGTTVTVSS |
| 18G1 | V$_H$5 | 70 | EVQLLESGGGLVQPGGSLRLSCAASRFTFSTYAMS WVRQAPGKGLEWVSGISGSGVSTHYADSVKGRFT ISRDNSKNTLYLQMNSLRAEDTAVYYCAKSLIVVI VYALDHWGQGTLVTVSS |
| 17D8 | V$_H$6 | 71 | EVQLLESGGGLVQPGGYLRLSCAASGFTFSTYAMS WVRQAPGKGLEWVSAISGSGVSTYYADSVKGRFT ISRDNSKNTLYLQMNSLRAEDTAVYYCAKSLIVV MVYVLDYWGQGTLVTVSS |
| 26H11 | V$_H$7 | 72 | EVQLLESGGGLVQPGGYLRLSCAASGFTFSTYAMS WVRQAPGKGLEWVSAISGSGVSTNYADSVKGRFT ISRDNSKNTLYLQMNSLRAEDTAVYYCAKSLIVV MVYVLDYWGQGTLVTVSS |
| 12E4 12C11 | V$_H$8 | 73 | EVQLLESGGGLVQPGGSLRLSCAASRFTFSTYAMS WVRQAPGKGLEWVSGISGSGVSTYYADSVKGRFT ISRDNSKNTLYLQMNSLRAEDTAVYYCAKSLIVVI VYALDYWGQGTLVTVSS |
| 21H2 | V$_H$9 | 74 | QVQLQESGPGLVKPSETLSLTCTVSGGSISSYYWS WIRQPAGKGLEWIGRIYTSGSTNYNPSLKSRVTMS KDTSKNQFSLKLRSVTAADTAVYYCARDPDGDYY YYGMDVWGQGTSVTVSS |
| 21B4 | V$_H$10 | 75 | QVQLQESGPGLVKPSETLSLTCTVSGGSISSYFWS WIRQPAGKGLEWIGRIYTSGSTNYNPSLKSRVTMS IDTSKNQFSLKLSSVTAADTAVYYCARDPDGDYY YYGMDVWGQGTTVTVSS |
| 18B11.1 | V$_H$11 | 76 | EVQLVESGGGLVKPGGSLRLSCAASGFTFSDAWM SWVRQAPGKGLEWVGRIKSKTDGGTTDYAAPVK GRFTISRDDSKNTLYLQMNSLKTEDTAVYFCTSTY SSGWYVWDYYGMDVWGQGTTVTVSS |
| 18B11.2 | V$_H$11 | 77 | EVQLVESGGGLVKPGGSLRLSCAASGFTFSDAWM SWVRQAPGKGLEWVGRIKSKTDGGTTDYAAPVK GRFTISRDDSKNTLYLQMNSLKTEDTAVYFCTSTY SSGWYVWDYYGMDVWGQGTTVTVSS |

TABLE 2B-continued

Exemplary Antibody Variable Heavy (V_H) Chains

| Contained in Clone | Designation | SEQ ID NO. | Amino Acid Sequence |
|---|---|---|---|
| 20D4 | V_H12 | 78 | QVQLVQSGAEVKKPGASVKVSCKVSGYTLTDLSM HWVRQAPGKGLEWMGGFDPEDGETIYAQKFQGR ITMTEDTSTDTAYMELSSLRSEDTAVYYCASIVVV PAAIQSYYYYYGMGVWGQGTTVTVSS |
| 46D11 | V_H13 | 79 | QVTLKEAGPVLVKPTETLTLTCTVSGFSLSNARMG VNWIRQPPGKALEWLAHIFSNDEKSYSTSLKSRLTI SKDTSKSQVVLTMTNMDPVDTATYYCARVRIAGD YYYYYGMDVWGQGTTVTVSS |
| 40D2 | V_H14 | 80 | QVQLQESGPGLVKPSQTLSLTCTVSGGSISSGGYN WSWIRQHPGKGLEWIGNIYYSGSTYYNPSLKSRVT ISVDTSKNQFSLKLRSVTAADTAVYYCARENIVVIP AAIFAGWFDPWGQGTLVTVSS |
| 37D3 | V_H15 | 81 | EVHLVESGGGLAKPGGSLRLSCAASGFTFRNAWM SWVRQAPGKGLEWVGRIKSKTDGGTTDYAAPVK GRFTISRDDSKNTLYLQMNSLKTEDTAEYYCITDR VLSYYAMAVWGQGTTVTVSS |
| 39F7 | V_H16 | 82 | QVQLVESGGGVVQPGRSLRLSCAASGFTFSNYGIH WVRQAPGKGLEWVAVIWYDGSIKYYADSVKGRF TISRDNSKNTLYLQMNSLRAEDTAVYYCARDRAA AGLHYYYGMDVWGQGTTVTVSS |
| 39F11 | V_H17 | 83 | QVQLVESGGGVVQPGRSLRLSCAASGFTFSSYGIH WVRQAPGKGLEWVAVIWYDGSDKYYADSVKGR FTISRDNSKNTLYLQMNSLRAEDTAVYYCARDRA AAGLHYYYGMDVWGQGTTVTVSS |
| 39G5 | V_H18 | 84 | QVQLVESGGGVVQPGRSLRLSCAVSGFTFSSYGIH WVRQAPGKGLEWVAVIWYDGSDKYYGDSVKGR FTISRDNSKNTLYLQMNSLRAEDTAVYYCARDRA AAGLHYYYGMDVWGQGTTVTVSS |

TABLE 2C

Coding Sequence for Antibody Variable Light (V_L) Chains

| Contained in Clone | Designation | SEQ ID NO. | Coding Sequence |
|---|---|---|---|
| 17C3 | V_L1 | 85 | TCCTATGTGCTGACTCAGCCACCCTCGGTGTCAG TGGCCCCAGGTCAGACGGCCAGGATTACCTGTG GGGGAAACAACATTGGAAGTCAGAGTGTGCACT GGTACCAGCAGAAGCCAGGCCAGGCCCCTGTCC TGGTCGTCTATGATGATAGCGACCGGCCCTCAG GGATCCCTGAGCGATTCTCTGGCTCCAACTCTGG GAACACGGCCACCCTGACCATCAGCAGGGTCGA AGCCGGGGATGAGGCCGACTATTACTGTCAGGT GTGGGATAGTAGTAGTGATCATGTGGTATTCGG CGGAGGGACCAAGCTGACCGTCCTA |
| 22H5 | V_L2 | 86 | TCCTATGTGCTGACTCAGCCACCCTCGGTGTCAG TGGCCCCAGGACAGACGGCCAGGATTACCTGTG GGGGAAACAACATTGGAAGTCAAAGTGTGCACT GGTACCAGCAGAAGCCAGGCCAGGCCCCTGTCC TGGTCGTCTATGATGATAGCGACCGGCCCTCAG GGATCCCTGAGCGATTCTCTGGCTCCAACTCTGG GAACACGGCCACCCTGACCATCAGCAGGGTCGA AGCCGGGGATGAGGCCGACTATTACTGTCAGGT GTGGGATAATACTAGTGATCATGTGGTATTCGG CGGGGGGACCAAACTGACCGTCCTA |
| 16H7 24H11 | V_L3 | 87 | TCCTATGTGCTGACTCAGCCACCCTCGGTGTCAG TGGCCCCAGGACAGACGGCCAGGATTACCTGTG GGGGAAACAACATTGGAAGTGAAAGTGTGCACT GGTACCAGCAGAAGCCAGGCCAGGCCCCTGTGC TGGTCGTCTATGATGATAGCGACCGGCCCTCAG GGATCCCTGAGCGATTCTCTGGCTCCAACTCTGG GAACACGGCCACCCTGACCATCAGCAGGGTCGA |

TABLE 2C-continued

Coding Sequence for Antibody Variable Light (V_L) Chains

| Contained in Clone | Designation | SEQ ID NO. | Coding Sequence |
|---|---|---|---|
| | | | AGCCGGGGATGAGGCCGACTATTACTGTCAGGT GTGGGATGGTAATAGTGATCATGTGGTATTCGG CGGAGGGACCAAGCTGACCGTCCTA |
| 18G1 | V_LA | 88 | GAAATTGTGTTGACGCAGTCTCCAGGCACCCTG TCTTTGTCTCCAGGGGAAAGAGCCACCCTCTCCT GCAGGGCCAGTCAGAATTTTGACAGCAGTTACT TAGCCTGGTACCAGCAGAAACCTGGCCAGGCTC CCCGGCTCCTCATCTATGGTACATCCAGCAGGG CCACTGGCATCCCAGACAGGTTCAGTGGCATTG GGTCTGGGACAGACTTCACTCTCACCATCAACA GACTGGAGCCTGAAGATTTTGCAATGTATTACT GTCAGCAGTATGGTGGCTCACCGCTCACTTTCGG CGGAGGGACCGAGGTGGAAATCAAA |
| 17D8 | V_L5 | 89 | GAAATTGTGTTGACGCAGTCTCCAGGCACCCTG TCTTTGTCTCCAGGGGAAAGAGCCACCCTCTCCT GCAGGGCCAGTCAGAGTGTTAGCGGCAACTACT TGGCCTGGTACCAGCAGAAACCTGGCCAGGCTC CCAGGCTCCTCATCTATGGTGCATCCAGCAGGG CCACTGGCATCCCAGACAGGTTCAGTGGCAGTG GGTCTGGGACAGACTTCACTCTCACCATCAGCA GACTGGAGCCTGAAGATTTTGCAGTGTATTATTG TCAGCAGTATGGTAGCGCACCGCTCACTTTCGG CGGAGGGACCAAGGTGGAAATCAAA |
| 26H11 | V_L6 | 90 | GAAATTGTGTTGACGCAGTCTCCAGGCACCCTG TCTTTGTCTCCAGGGGAAAGAGCCACCCTCTCCT GCAGGGCCAGTCAGAGTGTTAGCGGCAACTACT TGGCCTGGTACCAGCAGAAACCTGGCCAGGCTC CCAGGCTCCTCATCTATGGTGCATCCAGCAGGG CCACTGGCATCCCAGACAGATTCAGTGGCAGTG GGTCTGGGACAGACTTCACTCTCACCATCAGCA GACTGGAGCCTGAAGATTTTGCAATGTATTATTG TCAGCAGTATGGTAGCTCACCGCTCACTTTCGGC GGAGGGTCCAAGGTGGAGATCAAA |
| 12E4 | V_L7 | 91 | GAAATTGTGTTGACGCAGTCTCCAGGCACCCTG TCTTTGTCTCCAGGGGAAAGAGCCACCCTCTCCT GCAGGGCCAGTCAGAATTTCGACAGCAACTACT TAGCCTGGTACCAGCAGAAGCCTGGCCAGGCTC CCCGGCTCCTCATCTATGGTGCATCCAGCAGGG CCACTGGCATCCCAGACAACTTCAGTGGCAGTG GGTCTGGGACAGACTTCACTCTCACCATCAGCA GACTGGAGCCTGAAGATTTTGCAATGTATTACT GTCAGCAGTATGGTAGTTCACCGCTCACTTTCGG CGGAGGGACCAAGGTGGAAATCAAA |
| 12C11 | V_L8 | 92 | GAAATTGTGTTGACGCAGTCTCCAGGCACCCTG TCTTTGTCTCCAGGGGAAAGGGCCACCCTCTCCT GCAGGGCCAGTCAGAATTTTGACAGCAGCTCCT TAGCCTGGTACCAGCAGAAACCTGGCCAGGCTC CCCGGCTCCTCATCTATGGTGCATCCAGCAGGG CCACTGGCATCCCAGACAGGTTCAGTGGCAGTG GGTCTGGGACAGACTTCACTCTCACCATCAGCA GACTGGAGCCTGAAGATTTTGCAATGTATTACT GTCAGCAGTGTGGTAGCTCACCGCTCACTTTCGG CGGAGGGACCAAGGTGGAAATCAAA |
| 21H2 21B4 | V_L9 | 93 | GAAATTGTGTTGACGCAGTCTCCAGGCACCCTG TCTTTGTCTCCAGGGGAAAGAGCCACCCTCTCCT GCAGGGCCAGTCAGAGTGTTAGCAGTACCTACT TAGCCTGGCACCAGCAGAAACCTGGCCAGGGTC TTAGGCTCCTCATCTATGGTGCATCCAGCAGGGC CACTGGCATCCCAGACAGGTTCAGTGGCAGTGG GTCTGGGACAGACTTCACTCTTACCATCAGCAG ACTGGAGCCTGAAGATTTTGCAGTGTATTACTGT CAGCAGTATGGAAGCTCATTCACTTTCGGCGGA GGGACCAGGGTGGAGATCAAA |
| 18B11.1 | V_L10 | 94 | GATATTGTGATGACTCAGTCTCCACTCTCCCTGC CCGTCACCCCTGGAGAGCCGGCCTCCATCTCCTG CAGGTCTAGTCAGAGCCTCCTGTATTATAATGG ATTCACCTATTTGGATTGGTTCCTGCAGAAGCCA GGGCAGTCTCCACATCTCCTGATCTATTTGGGTT |

TABLE 2C-continued

Coding Sequence for Antibody Variable Light (V_L) Chains

| Contained in Clone | Designation | SEQ ID NO. | Coding Sequence |
|---|---|---|---|
|  |  |  | CTAATCGGGCCTCCGGGGTCCCTGACAGGTTCA<br>GTGGCAGTGTTTCAGGCACAGATTTTACACTGA<br>AAATCAGCAGAGTGGAGGCTGAGGATGTTGGGG<br>TTTATTATTGCATGCAGTCTCTGCAAACTCCATT<br>CACTTTCGGCCCTGGGACCAAAGTGGATATCAAA |
| 18B11.2 | V_L11 | 95 | GAAATAGTGATGACGCAGTCTCCAGCCACCCTG<br>TCTGTGTCTCCAGGGGAAAGAGCCACCCTCTCCT<br>GCAGGGCCAGTCAGAGTGTTAACAGCAACTTAG<br>CCTGGTACCAGCAGAAACCTGGCCAGGCTCCCA<br>GGCTCCTCATTTATGGTGTATCCACCAGGGCCAC<br>TGGTATCCCAGCCAGGTTCAGTGGCAGTGGGTC<br>TGGGACAGAGTTCACTCTCACCATCCGCAGCCT<br>GCAGTCTGAAGATTTTGCAGTTTATTACTGTCAG<br>CAGTATAATAACTGGCCTCCGACGTTCGGCCAA<br>GGGACCAAGGTGGAAATCAAA |
| 20D4 | V_L12 | 96 | GACATACAGCTGACCCAGTCTCCATCCTCCCTGT<br>CTGCATCTATAGGAGACAGAGTCACCATCACTT<br>GCCGGGCAAGTCAGGACATTAGATATGATTTAG<br>GCTGGTATCAGCAGAAACCAGGGAAAGCCCCTA<br>AGCGCCTGATCTATGCTGCATCCAGTTTGCAAA<br>GTGGGGTCCCTTCAAGGTTCAGCGGCAGTGGAT<br>CTGGGACAGAATTCACTCTCACAGTCAGCAGCC<br>TGCAGCCTGAAGATTTTGCAACTTATTACTGTCT<br>ACAGCATAATAGTTACCCTCTCACTTTCGGCGGA<br>GGGACCAAGGTGGAGATCGAA |
| 46D11 | V_L13 | 97 | GACATCCAGATGACCCAGTCTCCCTCTTCCGTGT<br>CTGCATCTGTAGGAGACAGAGTCACCATCACTT<br>GTCGGGCGAGTCAGGGTATTAGCATCTGGTTAG<br>CCTGGTATCAGCAGAAACCTGGGAAAGCCCCTA<br>AACTCCTGATCTATGCTGCATCCAGTTTGCAAAG<br>TGGGGTCCCATCAAGGTTCAGCGGCAGTGGATC<br>TGGGACAGATTTCACTCTCACCATCAGCAGCCT<br>GCAGCCTGAAGATTTTGCAACTTACTATTGTCAA<br>CAGGCTAACGATTTCCCGATCACCTTCGGCCAA<br>GGGACACGACTGGAGATTAAA |
| 40D2 | V_L14 | 98 | GATTTTGTGATGACCCAGACTCCACTCTCTCTGT<br>CCGTCACCCCTGGACAGCCGGCCTCCATCTCCTG<br>CAAGTCTAGTCAGAGCCTCCTACAGAGTGATGG<br>AAAGACCTATTTGTATTGGTACCTGCAGAAGCC<br>AGGCCAGCCTCCACATCTCCTGATCTATGAAGTT<br>TCCAACCGATTCTCTGGAGTGCCAGATAGGTTC<br>AGTGGCAGCGGGTCAGGGACAGATTTCACACTG<br>AAAATCAGCCGGGTGGAGGCTGAGGATGTTGGG<br>GTTTATTACTGCATGCAAAGTATACAGCTTCCTC<br>GGACGTTCGGCCAAGGGACCAAGGTGGAAATCA<br>AA |
| 37D3 | V_L15 | 99 | GATATTGTGATGACTCAGTCTCCACTCTCCCTGC<br>CCGTCACCCCTGGAGAGCCGGCCTCCATCTCCTG<br>CAGGTCTAGTCAGAGCCTCCTGCATAGTAATGG<br>ATACAACTTTTTGGATTGGTACCTACAGAAGCC<br>AGGGCAGTCTCCACAGCTCCTGATCTATTTGGGT<br>TCTGATCGGGCCTCCGGGGTCCCTGACAGGTTC<br>AGTGGCAGTGGATCAGGCACAGAGTTTACACTG<br>AAAATCAGCAGAGTGGAGGCTGAGGATGTTGGG<br>CTTTATTACTGCATGCAAGCTCTACAAACTCCGT<br>GCAGTTTTGGCCAGGGGACCAAGCTGGAGATCA<br>AA |
| 39F7 | V_L16 | 100 | GAAATTGTGTTGACGCAGTCTCCAGGCACCCTG<br>TCTTTGTCTCCAGGGGAAAGAGCCACCCTCTCCT<br>GCAGGGCCAGTCAGAGTGTTAGTAGCACCTATT<br>TAGCCTGGTACCAGCAGAAACCTGGCCAGGCTC<br>CCAGGCTCCTCATCTATGGTGCATCCAGCAGGG<br>CCACTGGCATCCCAGACAGGTTCAGTGGCAGTG<br>GGTCTGGGACAGACTTCACTCTCACCATCAGCA<br>GACTGGAGCCTGAAGATTTTGCAGTTTATTACTG<br>TCAGCAGTCTGGTAGCTCACCGCTCACTTTCGGC<br>GGAGGGACCGAGGTGGAGATCAAA |

TABLE 2C-continued

Coding Sequence for Antibody Variable Light (V$_L$) Chains

| Contained in Clone | Designation | SEQ ID NO. | Coding Sequence |
|---|---|---|---|
| 39F11 | V$_L$17 | 101 | GAAATTGTGTTGACGCAGTCTCCAGGCACCCTG<br>TCTTTGTCTCCAGGGGAAAGAGCCACCCTCTCCT<br>GCAGGGCCAGTCAGAGTGTTAGCAGCACCTACT<br>TAGCCTGGTACCAGCAGAAACCTGGCCAGGCTC<br>CCAGTCTCCTCATCTATGGTGCATCCAGCAGGGC<br>CACTGGCATCCCAGACAGGTTCAGTGGCAGTGG<br>GTCTGGGACAGACTTCACTCTCACCATCAGCAG<br>ACTGGAGCCTGAGGATTTTGCAGTGTATTACTGT<br>CAGCAGTCTGGTAGCTCACCTCTCACTTTCGGCG<br>GAGGGACCAAGGTGGAGATCAAA |
| 30G5 | V$_L$18 | 102 | GAAATTGTGTTGACGCAGTCTCCAGGCACCCTG<br>TCTTTGTCTCCAGGGGAAAGAGCCACCCTCTCCT<br>GCAGGGCCAGTCAGAGTGTTAGCAGCACCTACT<br>TAGCCTGGTACCAGCAGAAACCTGGCCAGGCTC<br>CCAGGCTCCTCATCTATGGTGCATCCTTCAGGGC<br>CACTGGCATCCCAGACAGGTTCAGTGGCAGTGG<br>GTCTGGGACAGACTTCACTCTCACCATCAGCAG<br>ACTGGAGCCTGAGGATTTTGCAGTGTATTACTGT<br>CAGCAGTCTGGTAGCTCACCTCTCACTTTCGGCG<br>GAGGGACCAAGGTGGAGATCAAA |

TABLE 2D

Coding Sequence for Antibody Variable Heavy (V$_H$) Chains

| Contained in Clone | Designation | SEQ ID NO. | Coding Sequence |
|---|---|---|---|
| 17C3 | V$_H$1 | 103 | CAGGTCACCTTGAAGGAGTCTGGTCCTGTGCTG<br>GTGAAACCCACAGAGACCCTCACGCTGACCTGC<br>ACCGTCTCTGGGTTCTCACTCAGCAATGCTAGAA<br>TGGGTGTGAGCTGGATCCGTCAGCCCCCAGGGA<br>AGGCCCTGGAGTGGCTTGCACACATTTTTTCGAA<br>TGACGAAAATCCTACAGCACATCTCTGAAGAG<br>CAGGCTCACCATCTCCAAGGACACCTCCAAAAG<br>CCAGGTGGTCCTTACCATGACCAACATGGACCC<br>TGTGGACACAGCCACATATTACTGTGCACGGAT<br>ATTATTACTGGGAGCTTACTACTACTACGGTATG<br>GACGTCTGGGGCCAAGGGACCACGGTCACCGTC<br>TCCTCA |
| 22H5 | V$_H$2 | 104 | CAGGTCACCTTGAAGGAGTCTGGTCCTGTGCTG<br>GTGAAACCCACAGAGACCCTCACGCTGACCTGC<br>ACCGTCTCTGGGTTCTCACTCAGCAATGCTAGAA<br>TGGGTGTGAGCTGGATCCGTCAGCCCCCAGGGA<br>AGGCCCTGGAGTGGCTTGCACACATTTTTTCGAA<br>TGACGAAAATCCTACAGCACATCTCTGAAGAG<br>CAGGCTCACCATCTCCAAGGACACCTCCAAAAG<br>CCAGGTGGTCCTTACCATGACCAACATGGACCC<br>TGTGGACACAGCCACATATTACTGTGCACGGAT<br>ATTATTAGTGGGAGCTTACTACTACTGCGGTATG<br>GACGTCTGGGGCCAAGGGACCACGGTCACCGTC<br>TCCTCA |
| 16H7 | V$_H$3 | 105 | CAGGTCACCTTGAAGGAGTCTGGTCCTGTGCTG<br>GTGAAACCCACAGAGACCCTCACGCTGACCTGC<br>ACCGTCTCTGGGTTCTCACTCAACAATGCTAGAA<br>TGGGTGTGAGCTGGATCCGTCAGCCCCCAGGGA<br>AGGCCCTGGAGTGGCTTGCACACATTTTTTCGAA<br>TGACGAAAATCCTACAGCACATCTCTGAAGAG<br>CAGGCTCACCATCTCCAAGGACACCTCCAAAAG<br>CCAGGTGGTCCTAATTATGACCAACATGGACCC<br>TGTGGACACAGCCACATATTACTGTGCACGGTC<br>AGTAGTAACTGGCGGCTACTACTACGACGGTAT<br>GGACGTCTGGGGCCAAGGGACCACGGTCACCGT<br>CTCCTCA |
| 24H11 | V$_H$4 | 106 | CAGGTCACCTTGAAGGAGTCTGGTCCTGTGCTG<br>GTGAAACCCACAGAGACCCTCACGCTGACCTGC<br>ACCGTCTCTGGGTTCTCACTCAGCAATGCTAGAA |

TABLE 2D-continued

Coding Sequence for Antibody Variable Heavy (V$_H$) Chains

| Contained in Clone | Designation | SEQ ID NO. | Coding Sequence |
|---|---|---|---|
| | | | TGGGTGTGAGCTGGATCCGTCAGCCCCAGGGA<br>AGGCCCTGGAGTGGCTTGCACACATTTTTTCGAA<br>TGACGAAAAATCCTACAGCACATCTCTGAAGAA<br>CAGGCTCACCATCTCCAAGGACACCTCCAAAAG<br>CCAGGTGGTCCTTATTATGACCAACATGGACCCT<br>GTGGACACAGCCACATATTACTGTGCACGGTCA<br>GTAGTGACTGGCGGCTACTACTACGACGGTATG<br>GACGTCTGGGGCCAAGGGACCACGGTCACCGTC<br>TCCTCA |
| 18G1 | V$_H$5 | 107 | GAGGTGCAGCTGTTGGAGTCTGGGGGAGGGTTG<br>GTACAGCCGGGGGGGTCCCTGAGACTCTCCTGT<br>GCAGCCTCTAGATTCACCTTTAGCACCTATGCCA<br>TGAGCTGGGTCCGCCAGGCTCCAGGGAAGGGGC<br>TGGAGTGGGTCTCAGGTATTAGTGGTAGTGGTG<br>TCAGCACACACTACGCAGACTCCGTGAAGGGCC<br>GGTTCACCATCTCCAGAGACAATTCCAAGAACA<br>CGCTGTATCTGCAAATGAACAGCCTGAGAGCCG<br>AGGACACGGCCGTATATTACTGTGCGAAATCCC<br>TCATTGTAGTAATAGTATATGCCCTTGACCACTG<br>GGGCCAGGGAACCCTGGTCACCGTCTCCTCA |
| 17D8 | V$_H$6 | 108 | GAGGTGCAGCTGTTGGAGTCTGGGGGAGGCTTG<br>GTACAGCCGGGGGGGTACCTGAGACTCTCCTGT<br>GCAGCCTCTGGATTCACGTTTAGTACCTATGCCA<br>TGAGCTGGGTCCGCCAGGCTCCAGGGAAGGGAC<br>TGGAGTGGGTCTCAGCTATCAGTGGTAGTGGTG<br>TTAGCACATACTACGCAGACTCCGTGAAGGGCC<br>GGTTCACCATCTCCAGAGACAATTCCAAGAACA<br>CGCTGTATCTGCAAATGAACAGCCTGAGAGCCG<br>AGGACACGGCCGTATATTACTGTGCGAAATCCC<br>TTATTGTAGTAATGGTGTATGTCCTTGACTACTG<br>GGGCCAGGGAACCCTGGTCACCGTCTCCTCA |
| 26H11 | V$_H$7 | 109 | GAGGTGCAGCTGTTGGAGTCTGGGGGAGGCTTG<br>GTACAGCCGGGGGGGTACCTGAGACTCTCCTGT<br>GCAGCCTCTGGATTCACGTTTAGCACCTATGCCA<br>TGAGCTGGGTCCGCCAGGCTCCAGGGAAGGGAC<br>TGGAGTGGGTCTCAGCTATTAGTGGCAGTGGTG<br>TGAGCACAAACTACGCAGACTCCGTGAAGGGCC<br>GGTTCACCATCTCCAGAGACAATTCCAAGAACA<br>CGCTGTATCTGCAAATGAACAGCCTGAGAGCCG<br>AGGACACGGCCGTATATTACTGTGCGAAATCCC<br>TTATTGTAGTAATGGTGTATGTCCTTGACTACTG<br>GGGCCAGGGAACCCTGGTCACCGTCTCCTCA |
| 12E4<br>12C11 | V$_H$8 | 110 | GAGGTGCAGCTGTTGGAGTCTGGGGGAGGGTTG<br>GTACAGCCGGGGGGGTCCCTGAGACTCTCCTGT<br>GCAGCCTCTAGATTCACCTTTAGCACCTATGCCA<br>TGAGCTGGGTCCGCCAGGCTCCAGGGAAGGGGC<br>TGGAGTGGGTCTCAGGTATTAGTGGTAGTGGTG<br>TTAGCACATACTACGCAGACTCCGTGAAGGGCC<br>GGTTCACCATCTCCAGAGACAATTCCAAGAACA<br>CGCTGTATCTGCAAATGAACAGCCTGAGAGCCG<br>AGGACACGGCCGTATATTACTGTGCGAAATCCC<br>TTATTGTAGTAATAGTATATGCCCTTGACTACTG<br>GGGCCAGGGAACCCTGGTCACCGTCTCCTCA |
| 21H2 | V$_H$9 | 111 | CAGGTGCAGCTGCAGGAGTCGGGCCCAGGACTG<br>GTGAAGCCTTCGGAGACCCTGTCCCTCACCTGC<br>ACTGTCTCTGGTGGCTCCATCAGTAGTTACTACT<br>GGAGCTGGATCCGGCAGCCCGCCGGGAAGGGA<br>CTGGAGTGGATTGGGCGTATCTATACCAGTGGG<br>AGCACCAACTACAACCCCTCCCTCAAGAGTCGG<br>GTCACCATGTCAAAAGACACGTCCAAGAACCAG<br>TTCTCCCTGAAGCTGAGGTCTGTGACCGCCGCG<br>GACACGGCCGTGTATTACTGTGCGAGAGATCCG<br>GACGGTGACTACTACTACTACGGTATGGACGTC<br>TGGGGCCAAGGGACCTCGGTCACCGTCTCCTCA |
| 21B4 | V$_H$10 | 112 | CAGGTGCAGCTGCAGGAGTCGGGCCCAGGACTG<br>GTGAAGCCTTCGGAGACCCTGTCCCTCACCTGC<br>ACTGTCTCTGGTGGCTCCATCAGTAGTTACTTCT<br>GGAGCTGGATCCGGCAGCCCGCCGGGAAGGGA<br>CTGGAGTGGATTGGGCGTATCTATACCAGTGGG |

TABLE 2D-continued

Coding Sequence for Antibody Variable Heavy (V$_H$) Chains

| Contained in Clone | Designation | SEQ ID NO. | Coding Sequence |
|---|---|---|---|
| | | | AGCACCAACTACAACCCTCCCTCAAGAGTCGA GTCACCATGTCAATAGACACGTCCAAGAACCAG TTCTCCCTGAAGCTGAGTTCTGTGACCGCCGCG ACACGGCCGTGTATTACTGTGCGAGAGATCCGG ACGGTGACTACTACTACTACGGTATGGACGTCT GGGGCCAAGGGACCACGGTCACCGTCTCCTCA |
| 18B11.1 18B11.2 | V$_H$11 | 113 | GAGGTGCAGCTGGTGGAGTCTGGGGGAGGCTTG GTAAAGCCTGGGGGGTCCCTTAGACTCTCCTGT GCAGCCTCTGGATTCACTTTCAGTGACGCCTGGA TGAGCTGGGTCCGCCAGGCTCCAGGGAAGGGGC TGGAGTGGGTTGGCCGTATTAAAAGCAAACTG ATGGTGGGACAACAGACTACGCTGCACCCGTGA AAGGCAGATTCACCATCTCAAGAGATGATTCAA AAAACACTCTGTATCTGCAAATGAACAGCCTGA AAACCGAGGACACAGCCGTGTATTTTTGTACCT CTACGTATAGCAGTGGCTGGTACGTATGGGACT ACTACGGTATGGACGTCTGGGGCCAAGGGACCA CGGTCACCGTCTCCTCA |
| 20D4 | V$_H$12 | 114 | CAGGTCCAGCTGGTACAGTCTGGGGCTGAGGTG AAGAAGCCTGGGGCCTCAGTGAAGGTCTCCTGC AAGGTTTCGGGATACACCCTCACTGATTTATCCA TGCACTGGGTGCGACAGGCTCCTGGAAAAGGGC TTGAGTGGATGGGAGGTTTTGATCCTGAAGATG GTGAAACAATCTACGCACAGAAGTTCCAGGGCA GAATCACCATGACCGAGGACACATCTACAGACA CAGCCTACATGGAGCTGAGCAGCCTGAGATCTG AGGACACGGCCGTGTATTACTGTGCAAGTATTG TAGTAGTCCCAGCTGCTATACAGAGTTACTACTA CTACTACGGTATGGGCGTCTGGGGCCAAGGGAC CACGGTCACCGTCTCCTCC |
| 46D11 | V$_H$13 | 115 | CAGGTCACCTTGAAGGAGGCTGGTCCTGTGTTG GTGAAACCCACAGAGACCCTCACGTTGACCTGC ACCGTCTCTGGGTTCTCACTCAGCAATGCTAGAA TGGGTGTGAACTGGATCCGTCAGCCCCCAGGGA AGGCCCTGGAGTGGCTTGCACACATTTTTTCGAA TGACGAAAAATCCTACAGCACATCTCTGAAGAG CAGGCTCACCATCTCCAAGGACACCTCCAAAAG CCAGGTGGTCCTTACCATGACCAACATGGACCC TGTGGACACAGCCACATATTACTGTGCACGGGT TCGTATAGCAGGTGATTACTACTACTACTACGGT ATGGACGTCTGGGGCCAAGGGACCACGGTCACC GTCTCCTCA |
| 40D2 | V$_H$14 | 116 | CAGGTGCAGCTGCAGGAGTCGGGCCCAGGACTG GTGAAGCCTTCACAGACCCTGTCCCTCACCTGCA CTGTCTCTGGTGGCTCCATCAGCAGTGGTGGTTA CAACTGGAGCTGGATCCGCCAGCACCCAGGGAA GGGCCTGGAGTGGATTGGGAACATCTATTACAG TGGGAGCACCTACTACAACCCGTCCCTCAAGAG TCGAGTTACCATATCAGTAGACACGTCTAAGAA CCAGTTCTCCCTGAAGCTGAGATCTGTGACTGCC GCGGACACGGCCGTGTATTACTGTGCGAGAGAG AATATTGTAGTAATACCAGCTGCTATATTCGCGG GTTGGTTCGACCCCTGGGGCCAGGGAACCCTGG TCACCGTCTCCTCA |
| 37D3 | V$_H$15 | 117 | GAGGTGCACCTGGTGGAGTCTGGGGGAGGCTTG GCAAAGCCTGGGGGGTCCCTTAGACTCTCCTGT GCAGCCTCTGGATTCACTTTCAGAAACGCCTGG ATGAGCTGGGTCCGCCAGGCTCCAGGAAAGGGG CTGGAATGGGTTGGCCGTATTAAAAGCAAAACT GATGGTGGGACAACAGACTACGCTGCACCCGTG AAAGGCAGATTCACCATCTCGAGAGATGATTCA AAAAACACGCTGTATCTGCAAATGAACAGCCTG AAACCGAGGACACAGCCGAGTATTACTGTATC ACAGATCGGGTGCTAAGCTACTACGCTATGGCC GTCTGGGGCCAAGGGACCACGGTCACCGTCTCC TCA |
| 39F7 | V$_H$16 | 118 | CAGGTGCAGCTGGTGGAGTCTGGGGGAGGCGTG GTCCAGCCTGGGAGGTCCCTGAGACTCTCCTGT GCAGCGTCTGGATTCACCTTCAGTAACTATGGC |

TABLE 2D-continued

Coding Sequence for Antibody Variable Heavy (V$_H$) Chains

| Contained in Clone | Designation | SEQ ID NO. | Coding Sequence |
|---|---|---|---|
| | | | ATTCACTGGGTCCGCCAGGCTCCAGGCAAGGGG CTGGAGTGGGTGGCAGTTATATGGTATGATGGA AGTATTAAATACTATGCAGACTCCGTGAAGGGC CGATTCACCATCTCCAGAGACAATTCCAAGAAC ACGCTGTATCTGCAAATGAACAGCCTGAGAGCC GAGGACACGGCTGTGTATTACTGTGCGAGAGAT AGGGCAGCAGCTGGTCTCCACTACTACTACGGT ATGGACGTCTGGGGCCAAGGGACCACGGTCACC GTCTCCTCA |
| 39F11 | V$_H$17 | 119 | CAGGTGCAGCTGGTGGAGTCTGGGGGAGGCGTG GTCCAGCCTGGGAGGTCCCTGAGACTCTCCTGT GCAGCGTCTGGATTCACCTTCAGTAGCTATGGC ATCCACTGGGTCCGCCAGGCTCCAGGCAAGGGG CTGGAATGGGTGGCAGTTATATGGTATGATGGA AGTGATAAATACTATGCAGACTCCGTGAAGGGC CGATTCACCATCTCCAGAGACAATTCCAAGAAC ACGCTGTATCTACAAATGAACAGCCTGAGAGCC GAGGACACGGCTGTGTATTACTGTGCGAGAGAT AGGGCAGCAGCTGGTCTCCACTATTATTACGGT ATGGACGTCTGGGGCCAAGGGACCACGGTCACC GTCTCCTCA |
| 39G5 | V$_H$18 | 120 | CAGGTGCAGCTGGTGGAGTCTGGGGGAGGCGTG GTCCAGCCTGGGAGGTCCCTGAGACTCTCCTGT GCAGTGTCTGGATTCACCTTCAGTAGCTATGGCA TCCACTGGGTCCGCCAGGCTCCAGGCAAGGGGC TGGAATGGGTGGCAGTTATATGGTATGATGGAA GTGATAAATACTATGGAGACTCCGTGAAGGGCC GATTCACCATCTCCAGAGACAATTCCAAGAACA CGCTGTATCTACAAATGAACAGCCTGAGAGCCG AGGACACGGCTGTGTATTACTGTGCGAGAGATA GGGCAGCAGCTGGTCTCCACTATTATTACGGTAT GGACGTCTGGGGCCAAGGGACCACGGTCACCGT CTCCTCA |

Each of the heavy chain variable regions listed in Table 2B can be combined with any of the light chain variable regions shown in Table 2A to form an antigen binding protein. Examples of such combinations include V$_H$1 combined with any of V$_L$1, V$_L$2, V$_L$3, V$_L$4, V$_L$5, V$_L$6, V$_L$7, V$_L$8, V$_L$9, V$_L$10, V$_L$11, V$_L$12, V$_L$13, V$_L$14, V$_L$15, V$_L$16, V$_L$17 or V$_L$18; V$_H$2 combined with any of V$_L$1, V$_L$2, V$_L$3, V$_L$4, V$_L$5, V$_L$6, V$_L$7, V$_L$8, V$_L$9, V$_L$10, V$_L$11, V$_L$12, V$_L$13, V$_L$14, V$_L$15, V$_L$16, V$_L$17 or V$_L$18; V$_H$3 combined with any of V$_L$1, V$_L$2, V$_L$3, V$_L$4, V$_L$5, V$_L$6, V$_L$7, V$_L$8, V$_L$9, V$_L$10, V$_L$11, V$_L$12, V$_L$13, V$_L$14, V$_L$15, V$_L$16, V$_L$17 or V$_L$18; and so on.

In some instances, the antigen binding protein includes at least one heavy chain variable region and/or one light chain variable region from those listed in Tables 2A and 2B. In some instances, the antigen binding protein includes at least two different heavy chain variable regions and/or light chain variable regions from those listed in Table 2B. An example of such an antigen binding protein comprises (a) one V$_H$1, and (b) one of V$_H$2, V$_H$3, V$_H$4, V$_H$5, V$_H$6, V$_H$7, V$_H$8, V$_H$9, V$_H$10, V$_H$11, V$_H$12, VH$_{13}$, VH$_{14}$, VH$_{15}$, VH$_{16}$, VH$_{17}$ or VH$_{18}$. Another example comprises (a) one V$_H$2, and (b) one of V$_H$1, V$_H$3, V$_H$4, V$_H$5, V$_H$6, V$_H$7, V$_H$8, V$_H$9, V$_H$10, V$_H$11, V$_H$12, V$_H$13, V$_H$14, V$_H$15, V$_H$16, V$_H$17 or V$_H$18. Again another example comprises (a) one V$_H$3, and (b) one of V$_H$1, V$_H$2, V$_H$4, V$_H$5, V$_H$6, V$_H$7, V$_H$8, V$_H$9, V$_H$10, V$_H$11, V$_H$12, V$_H$13, V$_H$14, V$_H$15 V$_H$16, V$_H$17 or V$_H$18, etc.

Again another example of such an antigen binding protein comprises (a) one V$_L$1, and (b) one of V$_L$2, V$_L$3, V$_L$4, V$_L$5, V$_L$6, V$_L$7, V$_L$8, V$_L$9, V$_L$10, V$_L$11, V$_L$12, V$_L$13, V$_L$14, V$_L$15, V$_L$16, V$_L$17, or V$_L$18. Again another example of such an antigen binding protein comprises (a) one V$_L$2, and (b) one of V$_L$1, V$_L$3, V$_L$4, V$_L$5, V$_L$6, V$_L$7, V$_L$8, V$_L$9, V$_L$10, V$_L$11 or V$_L$12. Again another example of such an antigen binding protein comprises (a) one V$_L$3, and (b) one of V$_L$1, V$_L$2, V$_L$4, V$_L$5, V$_L$6, V$_L$7, V$_L$8, V$_L$9, V$_L$10, V$_L$11, V$_L$12, V$_L$13, V$_L$14, V$_L$15, V$_L$16, V$_L$17, or V$_L$18, etc.

The various combinations of heavy chain variable regions can be combined with any of the various combinations of light chain variable regions.

In other embodiments, an antigen binding protein comprises two identical light chain variable regions and/or two identical heavy chain variable regions. As an example, the antigen binding protein can be an antibody or immunologically functional fragment thereof that includes two light chain variable regions and two heavy chain variable regions in combinations of pairs of light chain variable regions and pairs of heavy chain variable regions as listed in Tables 2A and 2B.

Some antigen binding proteins that are provided comprise a heavy chain variable domain comprising a sequence of amino acids that differs from the sequence of a heavy chain variable domain selected from V$_H$1, V$_H$2, V$_H$3, V$_H$4, V$_H$5, V$_H$6, V$_H$7, V$_H$8, V$_H$9, V$_H$10, V$_H$11, V$_H$12, V$_H$13, V$_H$14, V$_H$15, V$_H$16, V$_H$17 and V$_H$18 at only 1, 2, 3, 4, 5, 6, 7, 8, 9, 10, 11, 12, 13, 14 or 15 amino acid residues, wherein each such sequence difference is independently either a deletion, insertion or substitution of one amino acid, with the deletions, insertions and/or substitutions resulting in no more than 15 amino acid changes relative to the foregoing variable domain sequences. The heavy chain variable region in some antigen binding proteins comprises a sequence of amino acids that has at least 70%, 75%, 80%, 85%, 90%, 95%, 97% or 99% sequence identity to the amino acid sequences of the heavy chain variable region of $V_H1$, $V_H2$, $V_H3$, $V_H4$, $V_H5$, $V_H6$, $V_H7$, $V_H8$, $V_H9$, $V_H10$, $V_H11$, $V_H12$, $V_H13$, $V_H14$, $V_H15$, $V_H16$, $V_H17$ and $V_H18$.

Certain antigen binding proteins comprise a light chain variable domain comprising a sequence of amino acids that differs from the sequence of a light chain variable domain selected from $V_L1$, $V_L2$, $V_L3$, $V_L4$, $V_L5$, $V_L6$, $V_L7$, $V_L8$, $V_L9$, $V_L10$, $V_L11$, $V_L12$, $V_L13$, $V_L14$, $V_L15$, $V_L16$, $V_L17$ and $V_L18$ at only 1, 2, 3, 4, 5, 6, 7, 8, 9, 10, 11, 12, 13, 14 or 15 amino acid residues, wherein each such sequence difference is independently either a deletion, insertion or substitution of one amino acid, with the deletions, insertions and/or substitutions resulting in no more than 15 amino acid changes relative to the foregoing variable domain sequences. The light chain variable region in some antigen binding proteins comprises a sequence of amino acids that has at least 70%, 75%, 80%, 85%, 90%, 95%, 97% or 99% sequence identity to the amino acid sequences of the light chain variable region of $V_L1$, $V_L2$, $V_L3$, $V_L4$, $V_L5$, $V_L6$, $V_L7$, $V_L8$, $V_L9$, $V_L10$, $V_L11$, $V_L12$, $V_L13$, $V_L14$, $V_L15$, $V_L16$, $V_L17$ or $V_L18$.

In additional instances, antigen binding proteins comprise the following pairings of light chain and heavy chain variable domains: $V_L1$ with $V_H1$, $V_L2$ with $V_H2$, $V_L2$ with $V_H3$, $V_L3$ with $V_H4$, $V_L4$ with $V_H5$, $V_L5$ with $V_H6$, $V_L6$ with $V_H7$, $V_L7$ with $V_H8$, $V_L8$ with $V_H8$, $V_L9$ with $V_H9$, $V_L9$ with $V_H10$, $V_L10$ with $V_H11$, $V_L11$ with $V_H11$, $V_L12$ with $V_H12$, $V_L13$ with $V_H13$, $V_L14$ with $V_H14$, $V_L15$ with $V_H15$, $V_L16$ with $V_H16$, $V_L17$ with $V_H17$ and $V_L18$ with $V_H18$. In some instances, the antigen binding proteins in the above pairings can comprise amino acid sequences that have 70%, 75%, 80%, 85%, 90%, 95%, 96%, 97%, 98% or 99% sequence identity with the specified variable domains.

Still other antigen binding proteins, e.g., antibodies or immunologically functional fragments, include variant forms of a variant heavy chain and a variant light chain as just described.

Antigen Binding Protein CDRs

In various embodiments, the antigen binding proteins disclosed herein can comprise polypeptides into which one or more CDRs are grafted, inserted and/or joined. An antigen binding protein can have 1, 2, 3, 4, 5 or 6 CDRs. An antigen binding protein thus can have, for example, one heavy chain CDR1 ("CDRH1"), and/or one heavy chain CDR2 ("CDRH2"), and/or one heavy chain CDR3 ("CDRH3"), and/or one light chain CDR1 ("CDRL1"), and/or one light chain CDR2 ("CDRL2"), and/or one light chain CDR3 ("CDRL3"). Some antigen binding proteins include both a CDRH3 and a CDRL3. Specific heavy and light chain CDRs are identified in Tables 3A and 3B, respectively and in Table 6C, infra.

Complementarity determining regions (CDRs) and framework regions (FR) of a given antibody can be identified using the system described by Kabat et al., in Sequences of Proteins of Immunological Interest, 5th Ed., US Dept. of Health and Human Services, PHS, NIH, NIH Publication no. 91-3242, 1991. As desired, the CDRs can also be redefined according an alternative nomenclature scheme, such as that of Chothia (see Chothia & Lesk, 1987, *J. Mol. Biol.* 196:901-917; Chothia et al., 1989, *Nature* 342:878-883 or Honegger & Pluckthun, 2001, *J. Mol. Biol.* 309:657-670). Certain antibodies that are disclosed herein comprise one or more amino acid sequences that are identical or have substantial sequence identity to the amino acid sequences of one or more of the CDRs presented in Table 3A (CDRHs) and Table 3B (CDRLs) and Table 6C, infra.

TABLE 3A

Exemplary CDRH Sequences

| Clone | SEQ ID NO: | Contained in Reference | Designation | Sequence |
|---|---|---|---|---|
| 20D4 | 121 | $V_H12$ | CDRH1-1 | DLSMH |
| 17C3 | 122 | $V_H1$ | CDRH1-2 | NARMGVS |
| 22H5 | | $V_H2$ | | |
| 16H7 | | $V_H3$ | | |
| 24H11 | | $V_H4$ | | |
| 18B11.1 | 123 | $V_H11$ | CDRH1-3 | DAWMS |
| 18B11.2 | | $V_H11$ | | |
| 18G1 | 124 | $V_H5$ | CDRH1-4 | TYAMS |
| 12C11 | | $V_H8$ | | |
| 12E4 | | $V_H8$ | | |
| 17D8 | | $V_H6$ | | |
| 26H11 | | $V_H7$ | | |
| 21B4 | 125 | $V_H10$ | CDRH1-5 | SYFWS |
| 46D11 | 126 | $V_H13$ | CDRH1-6 | NARMGVN |
| 37D3 | 127 | $V_H15$ | CDRH1-7 | NAWMS |
| 39F11 | 128 | $V_H17$ | CDRH1-8 | SYGIH |
| 39G5 | | $V_H18$ | | |
| 39F7 | 129 | $V_H16$ | CDRH1-9 | NYGIH |
| 40D2 | 130 | $V_H14$ | CDRH1-10 | SGGYNWS |
| 21H2 | 131 | $V_H9$ | CDRH1-11 | SYYWS |
| 20D4 | 132 | $V_H12$ | CDRH2-1 | GFDPEDGETIYAQKFQG |
| 17C3 | 133 | $V_H1$ | CDRH2-2 | HIFSNDEKSYSTSLKS |
| 22H5 | | $V_H2$ | | |
| 16H7 | | $V_H3$ | | |
| 46D11 | | $V_H13$ | | |
| 24H11 | 134 | $V_H4$ | CDRH2-3 | HIFSNDEKSYSTSLKN |
| 18B11.1 | 135 | $V_H11$ | CDRH2-4 | RIKSKTDGGTTDYAAPVKG |
| 18B11.2 | | $V_H11$ | | |
| 37D3 | | $V_H15$ | | |
| 18G1 | 136 | $V_H5$ | CDRH2-5 | GISGSGVSTHYADSVKG |
| 12C11 | 137 | $V_H8$ | CDRH2-6 | GISGSGVSTYYADSVKG |
| 12E4 | | $V_H8$ | | |
| 17D8 | 138 | $V_H6$ | CDRH2-7 | AISGSGVSTYYADSVKG |
| 26H11 | 139 | $V_H7$ | CDRH2-8 | AISGSGVSTNYADSVKG |
| 21B4 | 140 | $V_H10$ | CDRH2-9 | RIYTSGSTNYNPSLKS |
| 21H2 | | $V_H9$ | | |
| 39F11 | 141 | $V_H17$ | CDRH2-10 | VIWYDGSDKYYADSVKG |
| 39F7 | 142 | $V_H16$ | CDRH2-11 | VIWYDGSIKYYADSVKG |
| 39G5 | 143 | $V_H18$ | CDRH2-12 | VIWYDGSDKYYGDSVKG |
| 40D2 | 144 | $V_H14$ | CDRH2-13 | NIYYSGSTYYNPSLKS |
| 20D4 | 145 | $V_H12$ | CDRH3-1 | IVVVPAAIQSYYYYYGMGV |
| 17C3 | 146 | $V_H1$ | CDRH3-2 | ILLLGAYYYYGMDV |
| 22H5 | 147 | $V_H2$ | CDRH3-3 | ILLVGAYYYCGMDV |
| 16H7 | 148 | $V_H3$ | CDRH3-4 | SVVTGGYYYDGMDV |
| 24H11 | | $V_H4$ | | |

TABLE 3A-continued

Exemplary CDRH Sequences

| Clone | SEQ ID NO: | Contained in Reference | Designation | Sequence |
|---|---|---|---|---|
| 18B11.1 18B11.2 | 149 | $V_H$11 $V_H$11 | CDRH3-5 | TYSSGWYVWDYYGMDV |
| 18G1 | 150 | $V_H$5 | CDRH3-6 | SLIVVIVYALDH |
| 12C11 12E4 | 151 | $V_H$8 $V_H$8 | CDRH3-7 | SLIVVIVYALDY |
| 17D8 26H11 | 152 | $V_H$6 $V_H$7 | CDRH3-8 | SLIVVMVYVLDY |
| 21B4 21H2 | 153 | $V_H$10 $V_H$9 | CDRH3-9 | DPDGDYYYYGMDV |
| 46D11 | 154 | $V_H$13 | CDRH3-10 | VRIAGDYYYYGMDV |
| 37D3 | 155 | $V_H$15 | CDRH3-11 | DRVLSYYAMAV |
| 39F11 39F7 39G5 | 156 | $V_H$17 $V_H$16 $V_H$18 | CDRH3-12 | DRAAAGLHYYYGMDV |
| 40D2 | 157 | $V_H$14 | CDRH3-13 | ENIVVIPAAIFAGWFDP |

TABLE 3B

Exemplary CDRL Sequences

| Clone | SEQ ID NO: | Contained in Reference | Designation | Sequence |
|---|---|---|---|---|
| 20D4 | 158 | $V_L$12 | CDRL1-1 | RASQDIRYDLG |
| 18B11.1 | 159 | $V_L$10 | CDRL1-2 | RSSQSLLYYNGFTYLD |
| 12C11 | 160 | $V_L$8 | CDRL1-3 | RASQNFDSSSLA |
| 18G1 | 161 | $V_L$4 | CDRL1-4 | RASQNFDSSYLA |
| 17D8 26H11 | 162 | $V_L$5 $V_L$6 | CDRL1-5 | RASQSVSGNYLA |
| 21B4 21H2 39F7 39F11 39G5 | 163 | $V_L$9 $V_L$9 $V_L$16 $V_L$17 $V_L$18 | CDRL1-6 | RASQSVSSTYLA |
| 12E4 | 164 | $V_L$7 | CDRL1-7 | RASQNFDSNYLA |
| 18B11.2 | 165 | $V_L$11 | CDRL1-8 | RASQSVNSNLA |
| 16H7 24H11 | 166 | $V_L$3 $V_L$3 | CDRL1-9 | GGNNIGSESVH |
| 22H5 17C3 | 167 | $V_L$2 $V_L$1 | CDRL1-10 | GGNNIGSQSVH |
| 46D11 | 168 | $V_L$13 | CDRL1-11 | RASQGISIWLA |
| 40D2 | 169 | $V_L$14 | CDRL1-12 | KSSQSLLQSDGKTYLY |
| 37D3 | 170 | $V_L$15 | CDRL1-13 | RSSQSLLHSNGYNFLD |
| 20D4 46D11 | 171 | $V_L$12 $V_L$13 | CDRL2-1 | AASSLQS |

TABLE 3B-continued

Exemplary CDRL Sequences

| Clone | SEQ ID NO: | Contained in Reference | Designation | Sequence |
|---|---|---|---|---|
| 18B11.1 | 172 | $V_L$10 | CDRL2-2 | LGSNRAS |
| 12C11 17D8 21B4 21H2 26H11 12E4 39F7 39F11 | 173 | $V_L$8 $V_L$5 $V_L$9 $V_L$9 $V_L$6 $V_L$7 $V_L$16 $V_L$17 | CDRL2-3 | GASSRAT |
| 18G1 | 174 | $V_L$4 | CDRL2-4 | GTSSRAT |
| 18B11.2 | 175 | $V_L$11 | CDRL2-5 | GVSTRAT |
| 16H7 24H11 22H5 17C3 | 176 | $V_L$3 $V_L$3 $V_L$2 $V_L$1 | CDRL2-6 | DDSDRPS |
| 40D2 | 177 | $V_L$14 | CDRL2-7 | EVSNRFS |
| 37D3 | 178 | $V_L$15 | CDRL2-8 | LGSDRAS |
| 39G5 | 179 | $V_L$18 | CDRL2-9 | GASFRAT |
| 20D4 | 180 | $V_L$12 | CDRL3-1 | LQHNSYPLT |
| 18B11.1 | 181 | $V_L$10 | CDRL3-2 | MQSLQTPFT |
| 12C11 | 182 | $V_L$8 | CDRL3-3 | QQCGSSPLT |
| 18G1 | 183 | $V_L$4 | CDRL3-4 | QQYGSSPLT |
| 17D8 | 184 | $V_L$5 | CDRL3-5 | QQYGSAPLT |
| 21B4 21H2 | 185 | $V_L$9 $V_L$9 | CDRL3-6 | QQYGSSFT |
| 26H11 12E4 | 186 | $V_L$6 $V_L$7 | CDRL3-7 | QQYGSSPLT |
| 18B11.2 | 187 | $V_L$11 | CDRL3-8 | QQYNNWPPT |
| 16H7 24H11 | 188 | $V_L$3 $V_L$3 | CDRL3-9 | QVWDGNSDHVV |
| 22H5 | 189 | $V_L$2 | CDRL3-10 | QVWDNTSDHVV |
| 17C3 | 190 | $V_L$1 | CDRL3-11 | QVWDSSSDHVV |
| 46D11 | 191 | $V_L$13 | CDRL3-12 | QQANDFPIT |
| 40D2 | 192 | $V_L$14 | CDRL3-13 | MQSIQLPRT |
| 37D3 | 193 | $V_L$15 | CDRL3-14 | MQALQTPCS |
| 39F7 39F11 39G5 | 194 | $V_L$16 $V_L$17 $V_L$18 | CDRL3-15 | QQSGSSPLT |

TABLE 3C

Coding Sequences for CDRHs

| Clone | SEQ ID NO: | Contained in Reference | Designation | Sequence |
|---|---|---|---|---|
| 20D4 | 195 | V$_H$12 | CDRH 1-1 | GATTTATCCATGCAC |
| 17C3 | 196 | V$_H$1 | CDRH 1-2 | AATGCTAGAATGGGTGTGAGC |
| 22H5 | | V$_H$2 | | |
| 16H7 | | V$_H$3 | | |
| 24H11 | | V$_H$4 | | |
| 18B11.1 | 197 | V$_H$11 | CDRH 1-3 | GACGCCTGGATGAGC |
| 18B11.2 | | V$_H$11 | | |
| 18G1 | 198 | V$_H$5 | CDRH 1-4 | ACCTATGCCATGAGC |
| 12C11 | | V$_H$8 | | |
| 12E4 | | V$_H$8 | | |
| 17D8 | | V$_H$6 | | |
| 26H11 | | V$_H$7 | | |
| 21B4 | 199 | V$_H$10 | CDRH 1-5 | AGTTACTTCTGGAGC |
| 21H2 | | V$_H$9 | | |
| 46D11 | 200 | V$_H$13 | CDRH 1-6 | AATGCTAGAATGGGTGTGAAC |
| 37D3 | 201 | V$_H$15 | CDRH 1-7 | AACGCCTGGATGAGC |
| 39F11 | 202 | V$_H$17 | CDRH 1-8 | AGCTATGGCATCCAC |
| 39G5 | | V$_H$18 | | |
| 39F7 | 203 | V$_H$16 | CDRH 1-9 | AACTATGGCATTCAC |
| 40D2 | 204 | V$_H$14 | CDRH 1-10 | AGTGGTGGTTACAACTGGAGC |
| 20D4 | 205 | V$_H$12 | CDRH 2-1 | GGTTTTGATCCTGAAGATGGTGAAACAATCTACGCACAGAAGTTCCAGGGC |
| 17C3 | 206 | V$_H$1 | CDRH 2-2 | CACATTTTTTCGAATGACGAAAAATCCTACAGCACATCTCTGAAGAGC |
| 22H5 | | V$_H$2 | | |
| 16H7 | | V$_H$3 | | |
| 46D11 | | V$_H$13 | | |
| 24H11 | 207 | V$_H$4 | CDRH 2-3 | CACATTTTTTCGAATGACGAAAAATCCTACAGCACATCTCTGAAGAAC |
| 18B11.1 | 208 | V$_H$11 | CDRH 2-4 | CGTATTAAAAGCAAAACTGATGGTGGACAACAGACTACGCTGCACCCGTGAAAGGC |
| 18B11.2 | | V$_H$11 | | |
| 37D3 | | V$_H$15 | | |
| 18G1 | 209 | V$_H$5 | CDRH 2-5 | GGTATTAGTGGTAGTGGTGTCAGCACACACTACGCAGACTCCGTGAAGGGC |
| 12C11 | 210 | V$_H$8 | CDRH 2-6 | GGTATTAGTGGTAGTGGTGTTAGCACATACTACGCAGACTCCGTGAAGGGC |
| 12E4 | | V$_H$8 | | |
| 17D8 | 211 | V$_H$6 | CDRH 2-7 | GCTATCAGTGGTAGTGGTGTTAGCACATACTACGCAGACTCCGTGAAGGGC |
| 26H11 | 212 | V$_H$7 | CDRH 2-8 | GCTATTAGTGGCAGTGGTGTGAGCACAAACTACGCAGACTCCGTGAAGGGC |
| 21B4 | 213 | V$_H$10 | CDRH 2-9 | CGTATCTATACCAGTGGGAGCACCAACTACAACCCCTCCCTCAAGAGT |
| 21H2 | | V$_H$9 | | |
| 39F11 | 214 | V$_H$17 | CDRH 2-10 | GTTATATGGTATGATGGAAGTGATAAATACTATGCAGACTCCGTGAAGGGC |
| 39F7 | 215 | V$_H$16 | CDRH 2-11 | GTTATATGGTATGATGGAAGTATTAAATACTATGCAGACTCCGTGAAGGGC |
| 39G5 | 216 | V$_H$18 | CDRH 2-12 | GTTATATGGTATGATGGAAGTGATAAATACTATGGAGACTCCGTGAAGGGC |

TABLE 3C-continued

Coding Sequences for CDRHs

| Clone | SEQ ID NO: | Contained in Reference | Designation | Sequence |
|---|---|---|---|---|
| 40D2 | 217 | $V_H14$ | CDRH 2-13 | AACATCTATTACAGTGGGAGCACCTACTACAA CCCGTCCCTCAAGAGT |
| 20D4 | 218 | $V_H12$ | CDRH 3-1 | ATTGTAGTAGTCCCAGCTGCTATACAGAGTTA CTACTACTACGGTATGGGCGTC |
| 17C3 | 219 | $V_H1$ | CDRH 3-2 | ATATTATTACTGGGAGCTTACTACTACTACGG TATGGACGTC |
| 22H5 | 220 | $V_H2$ | CDRH 3-3 | ATATTATTAGTGGGAGCTTACTACTACTGCGG TATGGACGTC |
| 16H7 24H11 | 221 | $V_H3$ $V_H4$ | CDRH 3-4 | TCAGTAGTAACTGGCGGCTACTACTACGACG GTATGGACGTC |
| 18B11.1 18B11.2 | 222 | $V_H11$ $V_H11$ | CDRH 3-5 | ACGTATAGCAGTGGCTGGTACGTATGGGAC TACTACGGTATGGACGTC |
| 18G1 | 223 | $V_H5$ | CDRH 3-6 | TCCCTCATTGTAGTAATAGTATATGCCCTTG ACCAC |
| 12C11 12E4 | 224 | $V_H8$ $V_H8$ | CDRH 3-7 | TCCCTTATTGTAGTAATAGTATATGCCCT TGACTAC |
| 17D8 26H11 | 225 | $V_H6$ $V_H7$ | CDRH 3-8 | TCCCTTATTGTAGTAATGGTGTATGTCCT TGACTAC |
| 21B4 21H2 | 226 | $V_H10$ $V_H9$ | CDRH 3-9 | GATCCGGACGGTGACTACTACTACTACG GTATGGACGTC |
| 46D11 | 227 | $V_H13$ | CDRH 3-10 | GTTCGTATAGCAGGTGATTACTACTACTA CTACGGTATGGACGTC |
| 37D3 | 228 | $V_H15$ | CDRH 3-11 | GATCGGGTGCTAAGCTACTACGCTATGG CCGTC |
| 39F11 39F7 39G5 | 229 | $V_H17$ $V_H16$ $V_H18$ | CDRH 3-12 | GATAGGGCAGCAGCTGGTCTCCACTATT ATTACGGTATGGACGTC |
| 40D2 | 230 | $V_H14$ | CDRH 3-13 | GAGAATATTGTAGTAATACCAGCTGCTAT ATTCGCGGGTTGGTTCGACCCC |

TABLE 3D

Coding Sequences for CDRLs

| Clone | SEQ ID NO: | Contained in Reference | Designation | Sequence |
|---|---|---|---|---|
| 20D4 | 231 | $V_L12$ | CDRL1-1 | CGGGCAAGTCAGGACATTAGATATGATT TAGGC |
| 18B11.1 | 232 | $V_L10$ | CDRL1-2 | AGGTCTAGTCAGAGCCTCCTGTATTATA ATGGATTCACCTATTTGGAT |
| 12C11 | 233 | $V_L8$ | CDRL1-3 | AGGGCCAGTCAGAATTTTGACAGCAGC TCCTTAGCC |
| 18G1 | 234 | $V_L4$ | CDRL1-4 | AGGGCCAGTCAGAATTTTGACAGCAGT TACTTAGCC |
| 17D8 26H11 | 235 | $V_L5$ $V_L6$ | CDRL1-5 | AGGGCCAGTCAGAGTGTTAGCGGCAAC TACTTGGCC |
| 21B4 21H2 39F7 39F11 39G5 | 236 | $V_L9$ $V_L9$ $V_L16$ $V_L17$ $V_L18$ | CDRL1-6 | AGGGCCAGTCAGAGTGTGAGCAGTACC TACTTAGCC |

TABLE 3D-continued

Coding Sequences for CDRLs

| Clone | SEQ ID NO: | Contained in Reference | Designation | Sequence |
|---|---|---|---|---|
| 12E4 | 237 | $V_L7$ | CDRL1-7 | AGGGCCAGTCAGAATTTCGACAGCAAC TACTTAGCC |
| 18B11.2 | 238 | $V_L11$ | CDRL1-8 | AGGGCCAGTCAGAGTGTTAACAGCAAC TTAGCC |
| 16H7 24H11 | 239 | $V_L3$ $V_L3$ | CDRL1-9 | GGGGGAAACAACATTGGAAGTGAAAGTG TGCAC |
| 22H5 17C3 | 240 | $V_L2$ $V_L1$ | CDRL1-10 | GGGGGAAACAACATTGGAAGTCAAAGTG TGCAC |
| 46D11 | 241 | $V_L13$ | CDRL1-11 | CGGGCGAGTCAGGGTATTAGCATCTGGT TAGCC |
| 40D2 | 242 | $V_L14$ | CDRL1-12 | AAGTCTAGTCAGAGCCTCCTACAGAGTG ATGGAAAGACCTATTTGTAT |
| 37D3 | 243 | $V_L15$ | CDRL1-13 | AGGTCTAGTCAGAGCCTCCTGCATAGTA ATGGATACAACTTTTTGGAT |
| 20D4 46D11 | 244 | $V_L12$ $V_L13$ | CDRL2-1 | GCTGCATCCAGTTTGCAAAGT |
| 18B11.1 | 245 | $V_L10$ | CDRL2-2 | TTGGGTTCTAATCGGGCCTCC |
| 12C11 17D8 21B4 21H2 26H11 12E4 39F7 39F11 | 246 | $V_L8$ $V_L5$ $V_L9$ $V_L9$ $V_L6$ $V_L7$ $V_L16$ $V_L17$ | CDRL2-3 | GGTGCATCCAGCAGGGCCACT |
| 18G1 | 247 | $V_L4$ | CDRL2-4 | GGTACATCCAGCAGGGCCACT |
| 18B11.2 | 248 | $V_L11$ | CDRL2-5 | GGTGTATCCACCAGGGCCACT |
| 16H7 24H11 22H5 17C3 | 249 | $V_L3$ $V_L3$ $V_L2$ $V_L1$ | CDRL2-6 | GATGATAGCGACCGGCCCTCA |
| 40D2 | 250 | $V_L14$ | CDRL2-7 | GAAGTTTCCAACCGATTCTCT |
| 37D3 | 251 | $V_L15$ | CDRL2-8 | TTGGGTTCTGATCGGGCCTCC |
| 20D4 | 252 | $V_L12$ | CDRL3-1 | CTACAGCATAATAGTTACCCTCTCACT |
| 18B11.1 | 253 | $V_L10$ | CDRL3-2 | ATGCAGTCTCTGCAAACTCCATTCACT |
| 12C11 | 254 | $V_L8$ | CDRL3-3 | CAGCAGTGTGGTAGCTCACCGCTCACT |
| 18G1 | 255 | $V_L4$ | CDRL3-4 | CAGCAGTATGGTGGCTCACCGCTCACT |
| 17D8 | 256 | $V_L5$ | CDRL3-5 | CAGCAGTATGGTAGCGCACCGCTCACT |
| 21B4 21H2 | 257 | $V_L9$ $V_L9$ | CDRL3-6 | CAGCAGTATGGAAGTTCATTCACT |
| 26H11 12E4 | 258 | $V_L6$ $V_L7$ | CDRL3-7 | CAGCAGTATGGTAGCTCACCGCTCACT |
| 18B11.2 | 259 | $V_L11$ | CDRL3-8 | CAGCAGTATAATAACTGGCCTCCGACG |
| 16H7 24H11 | 260 | $V_L3$ $V_L3$ | CDRL3-9 | CAGGTGTGGGATGGTAATAGTGATCAT GTGGTA |
| 22H5 | 261 | $V_L2$ | CDRL3-10 | CAGGTGTGGGATAATACTAGTGATCAT GTGGTA |

TABLE 3D-continued

Coding Sequences for CDRLs

| Clone | SEQ ID NO: | Contained in Reference | Designation | Sequence |
|---|---|---|---|---|
| 17C3 | 262 | $V_L1$ | CDRL3-11 | CAGGTGTGGGATAGTAGTAGTGATCATGTGGTA |
| 46D11 | 263 | $V_L13$ | CDRL3-12 | CAACAGGCTAACGATTTCCCGATCACC |
| 40D2 | 264 | $V_L14$ | CDRL3-13 | ATGCAAAGTATACAGCTTCCTCGGACG |
| 37D3 | 265 | $V_L15$ | CDRL3-14 | ATGCAAGCTCTACAAACTCCGTGCAGT |
| 39F7 39F11 39G5 | 266 | $V_L16$ $V_L17$ $V_L18$ | CDRL3-15 | CAGCAGTCTGGTAGCTCACCTCTCACT |

The structure and properties of CDRs within a naturally occurring antibody has been described, supra. Briefly, in a traditional antibody, the CDRs are embedded within a framework in the heavy and light chain variable region where they constitute the regions responsible for antigen binding and recognition. A variable region comprises at least three heavy or light chain CDRs, see, supra (Kabat et al., 1991, *Sequences of Proteins of Immunological Interest*, Public Health Service N.I.H., Bethesda, Md.; see also Chothia and Lesk, 1987, *J. Mol. Biol.* 196:901-917; Chothia et al., 1989, *Nature* 342: 877-883), within a framework region (designated framework regions 1-4, FR1, FR2, FR3, and FR4, by Kabat et al., 1991; see also Chothia and Lesk, 1987, supra). The CDRs provided herein, however, can not only be used to define the antigen binding domain of a traditional antibody structure, but can be embedded in a variety of other polypeptide structures, as described herein.

In one aspect, the CDRs provided are (a) a CDRH selected from the group consisting of (i) a CDRH1 selected from the group consisting of SEQ ID NO:121-131; (ii) a CDRH2 selected from the group consisting of SEQ ID NO:132-144; (iii) a CDRH3 selected from the group consisting of SEQ ID NO:145-157; and (iv) a CDRH of (i), (ii) and (iii) that contains one or more amino acid substitutions, deletions or insertions of no more than five, four, three, two, or one amino acids; (B) a CDRL selected from the group consisting of (i) a CDRL1 selected from the group consisting of SEQ ID NO:158-170; (ii) a CDRL2 selected from the group consisting of SEQ ID NO:171-179; (iii) a CDRL3 selected from the group consisting of SEQ ID NO:180-194; and (iv) a CDRL of (i), (ii) and (iii) that contains one or more amino acid substitutions, deletions or insertions of no more than 1, 2, 3, 4, or 5 amino acids amino acids.

In another aspect, an antigen binding protein comprises 1, 2, 3, 4, 5, or 6 variant forms of the CDRs listed in Tables 3A and 3B and Table 6C, infra, each having at least 80%, 85%, 90%, 95%, 96%, 97%, 98%, or 99% sequence identity to a CDR sequence listed in Tables 3A and 3B and Table 6C, infra. Some antigen binding proteins comprise 1, 2, 3, 4, 5, or 6 of the CDRs listed in Tables 3A and 3B and Table 6C, infra, each differing by no more than 1, 2, 3, 4 or 5 amino acids from the CDRs listed in these tables.

In still another aspect, an antigen binding protein includes the following associations of CDRL1, CDRL2 and CDRL3: SEQ ID NOs:167, 176, and 190; SEQ ID NOs:167, 176, and 189, SEQ ID NOs:166, 176, and 188; SEQ ID NOs:166, 176, and 188; SEQ ID NOs:161, 174, and 183; SEQ ID NOs:162, 173, and 184; SEQ ID NOs:162, 173, and 186; SEQ ID NOs:164, 173, and 186; SEQ ID NOs:160, 173, and 182; SEQ ID NOs:163, 173, and 185; SEQ ID NOs:163, 173, and 185; SEQ ID NOs:159, 172, and 181; SEQ ID NOs:165, 175, and 187; SEQ ID NOs:158, 171, and 180; SEQ ID NOs:168, 171, and 191; SEQ ID NOs:169, 177 and 192; SEQ ID NOs:170, 178, and 193; SEQ ID NOs:163, 173, and 194; SEQ ID NOs:163, 173 and 194; and SEQ ID NOs:163, 179, and 194.

In an additional aspect, an antigen binding protein includes the following associations of CDRH1, CDRH2 and CDRH3: SEQ ID NOs:122, 133, and 146; SEQ ID NOs:122, 133, and 147; SEQ ID NOs:122, 133, and 148; SEQ ID NOs:122, 134, and 148; SEQ ID NOs:124, 136, and 150; SEQ ID NOs:124, 138, and 152; SEQ ID NOs:124, 139, and 152; SEQ ID NOs:124, 137, and 151; SEQ ID NOs:124, 137, and 151; SEQ ID NOs:131, 140, and 153; SEQ ID NOs:125, 140, and 153; SEQ ID NOs:123, 135, and 149; SEQ ID NOs:123, 135, and 149; SEQ ID NOs:121, 132, and 145; SEQ ID NOs:126, 133, and 154; SEQ ID NOs:130, 144, and 157; SEQ ID NOs:127, 135, and 155; SEQ ID NOs:129, 142, and 156; SEQ ID NOs:128, 141, and 156; and SEQ ID NOs:128, 143, and 156.

In another aspect, an antigen binding protein includes the following associations of CDRL1, CDRL2 and CDRL3 with CDRH1, CDRH2 and CDRH3: SEQ ID NOs:167, 176, and 190; SEQ ID NOs:167, 176, and 189, SEQ ID NOs:166, 176, and 188; SEQ ID NOs:166, 176, and 188; SEQ ID NOs:161, 174, and 183; SEQ ID NOs:162, 173, and 184; SEQ ID NOs:162, 173, and 186; SEQ ID NOs:164, 173, and 186; SEQ ID NOs:160, 173, and 182; SEQ ID NOs:163, 173, and 185; SEQ ID NOs:163, 173, and 185; SEQ ID NOs:159, 172, and 181; SEQ ID NOs:165, 175, and 187; SEQ ID NOs:158, 171, and 180; SEQ ID NOs:168, 171, and 191; SEQ ID NOs:169, 177 and 192; SEQ ID NOs:170, 178, and 193; SEQ ID NOs: 163, 173, and 194; SEQ ID NOs:163, 173 and 194; SEQ ID NOs:163, 179, and 194 with SEQ ID NOs:122, 133, and 146; SEQ ID NOs:122, 133, and 147; SEQ ID NOs:122, 133, and 148; SEQ ID NOs:122, 134, and 148; SEQ ID NOs:124, 136, and 150; SEQ ID NOs:124, 138, and 152; SEQ ID NOs:124, 139, and 152; SEQ ID NOs:124, 137, and 151; SEQ ID NOs:124, 137, and 151; SEQ ID NOs:131, 140, and 153; SEQ ID NOs:125, 140, and 153; SEQ ID NOs:123, 135, and 149; SEQ ID NOs:123, 135, and 149; SEQ ID NOs:121, 132, and 145; SEQ ID NOs:126, 133, and 154; SEQ ID NOs:130, 144, and 157; SEQ ID NOs:127, 135, and 155; SEQ ID NOs:129, 142, and 156; SEQ ID NOs:128, 141, and 156; and SEQ ID NOs:128, 143, and 156.

Consensus Sequences

In yet another aspect, the CDRs disclosed herein include consensus sequences derived from groups of related monoclonal antibodies. As described herein, a "consensus sequence" refers to amino acid sequences having conserved amino acids common among a number of sequences and variable amino acids that vary within a given amino acid sequences. The CDR consensus sequences provided include CDRs corresponding to each of CDRH1, CDRH2, CDRH3, CDRL1, CDRL2 and CDRL3.

Consensus sequences were determined using standard analyses of the CDRs corresponding to the $V_H$ and $V_L$ of the disclosed antibodies, some of which specifically bind (i) β-Klotho; (ii) FGFR1c, FGFR2c, FGFR3c or FGFR4; or (iii) a complex comprising β-Klotho and one of FGFR1c, FGFR2c, FGFR3c, and FGFR4. The consensus sequences were determined by keeping the CDRs contiguous within the same sequence corresponding to a $V_H$ or $V_L$.

Light Chain CDR3

Group 1
LQHNSYPLT (SEQ ID NO: 267)

Group 2
MQSLQTPFT (SEQ ID NO: 268)

Group 3
QQYNNWPPT (SEQ ID NO: 269)

Group 4
MQSIQLPRT (SEQ ID NO: 270)

Group 5
QQANDFPIT (SEQ ID NO: 271)

Group 6
MQALQTPCS (SEQ ID NO: 272)

Group 7
QVWD G    N    SDHVV (SEQ ID NO: 273)

QVWD N    T    SDHVV (SEQ ID NO: 274)

QVWD S    S    SDHVV (SEQ ID NO: 275)

QVWD $X_1$ $X_2$ SDHVV (SEQ ID NO: 276)

wherein $X_1$ is G, S or N and $X_2$ is S, T or N.

Group 8
QQ   C   G   S   S   P   L   T (SEQ ID NO: 277)

QQ   Y   G   G   S   P   L   T (SEQ ID NO: 278)

QQ   Y   G   S   A   P   L   T (SEQ ID NO: 279)

QQ   Y   G   S   S   F       T (SEQ ID NO: 280)

QQ   Y   G   S   S   P   L   T (SEQ ID NO: 281)

QQ   S   G   S   S   P   L   T (SEQ ID NO: 282)

QQ   $X_3$   G   $X_4$   $X_5$   $X_6$   $X_7$   T (SEQ ID NO: 283)
wherein $X_3$ is C, Y or S, $X_4$ is S or G, $X_5$ is S or A, $X_6$ is P or F and $X_7$ is L or absent.

Light Chain CDR2

Group 1
AASSLQS (SEQ ID NO: 284)

Group 2
GVSTRAT (SEQ ID NO: 285)

Group 3
DDSDRPS (SEQ ID NO: 286)

Group 4
EVSNRFS (SEQ ID NO: 287)

Group 5
L   G   S   N   R   A   S (SEQ ID NO: 288)

L   G   S   D   R   A   S (SEQ ID NO: 289)

L   G   S   $X_{27}$   R   A   S (SEQ ID NO: 290)

wherein $X_{27}$ is N or D.

Group 6
G A   S   S   RAT (SEQ ID NO: 291)

G T   S   S   RAT (SEQ ID NO: 292)

G A   S   F   RAT (SEQ ID NO: 293)

G $X_8$   S   $X_{28}$ RAT (SEQ ID NO: 294)

wherein $X_8$ is A or T and $X_{28}$ is S or F.

Light Chain CDR1

Group 1
RASQSVNSNLA    (SEQ ID NO: 295)

Group 2
RASQDIRYDLG    (SEQ ID NO: 296)

Group 3
RASQGISIWLA    (SEQ ID NO: 297)

Group 4
KSSQSLLQSDGKTYLY (SEQ ID NO: 298)

Group 5
RASQ N   F   D   S   S   S   LA (SEQ ID NO: 299)

RASQ N   F   D   S   S   Y   LA (SEQ ID NO: 300)

RASQ S   V   S   G   N   Y   LA (SEQ ID NO: 301)

RASQ S   V   S   G   T   Y   LA (SEQ ID NO: 302)

RASQ N   F   D   S   N   Y   LA (SEQ ID NO: 303)

RASQ $X_9$   $X_{10}$ $X_{11}$ $X_{12}$ $X_{13}$ $X_{14}$ LA (SEQ ID NO: 304)

wherein $X_9$ is A or S, $X_{10}$ is V or F, $X_{11}$ is D or S, $X_{12}$ is G or S, $X_{13}$ is S, N or T, and $X_{14}$ is S or Y.

Group 6
GGNNIGS   E   SVH (SEQ ID NO: 305)

GGNNIGS   Q   SVH (SEQ ID NO: 306)

GGNNIGS   $X_{15}$ SVH (SEQ ID NO: 307)

wherein $X_{15}$ is E or Q.

Group 7
RSSQSLL   Y   Y   NG F   T   Y   LD (SEQ ID NO: 308)

RSSQSLL   H   S   NG Y   N   F   LD (SEQ ID NO: 309)

RSSQSLL   $X_{29}$ $X_{30}$ NG $X_{31}$   $X_{32}$ $X_{33}$ LD (SEQ ID NO: 310)

wherein $X_{29}$ is Y or H, $X_{30}$ is Y or S, $X_{31}$ is F or Y, $X_{32}$ is T or N and $X_{33}$ is Y or F.

Heavy CDR3

Group 1
IVVVPAAIQSYYYYYGMGV (SEQ ID NO: 311)

Group 2
DPDGDYYYYGMDV (SEQ ID NO: 312)

Group 3
TYSSGWYVWDYYGMDV (SEQ ID NO: 313)

Group 4
DRVLSYYAMAV (SEQ ID NO: 314)

Group 5
VRIAGDYYYYYGMDV (SEQ ID NO: 315)

Group 6
ENIVVIPAAIFAGWFDP (SEQ ID NO: 316)

Group 7
DRAAAGLHYYYGMDV (SEQ ID NO: 317)

Group 8
| I | L | L | L | G | A | YYYY |   | GMDV | (SEQ ID NO: 318) |
| I | L | L | V | G | A | YYY | C | GMDV | (SEQ ID NO: 319) |
| V | V | T |   | G | G | YYY | D | GMDV | (SEQ ID NO: 320) |
| S | V | V | T | G |   | YYY | D | GMDV | (SEQ ID NO: 321) |
| $X_{34}$ | $X_{16}$ | $X_{17}$ | $X_{18}$ | G | $X_{19}$ | YYY | $X_{20}$ | GMDV | (SEQ ID NO: 322) |

Wherein $X_{34}$ is I, V or S, $X_{16}$ is L or V,
$X_{17}$ is L, T or V, $X_{18}$ is L, V, G or T,
$X_{19}$ is A, G or absent and $X_{20}$ is Y, C or D.

Group 9
| SLIVV | I | VY | A | LD | H | (SEQ ID NO: 323) |
| SLIVV | I | VY | A | LD | Y | (SEQ ID NO: 324) |
| SLIVV | M | VY | V | LD | Y | (SEQ ID NO: 325) |
| SLIVV | $X_{21}$ | VY | $X_{22}$ | LD | $X_{23}$ | (SEQ ID NO: 326) |

Wherein $X_{21}$ is I or M, $X_{22}$ is A or V and $X_{23}$ is H or Y.

Heavy CDR2

Group 1
GFDPEDGETIYAQKFQG (SEQ ID NO: 327)

Group 2
RIKSK T DGGTTDYAAPVKG (SEQ ID NO: 328)

RIKSK   DGGTTDYAAPVKG (SEQ ID NO: 330)

RIKSK $X_{42}$ DGGTTDYAAPVKG (SEQ ID NO: 483)

wherein $X_{42}$ is T or absent.

Group 3
HIFSNDEKSYSTSLK S (SEQ ID NO: 331)

HIFSNDEKSYSTSLK N (SEQ ID NO: 332)

HIFSNDEKSYSTSLK $X_{24}$ (SEQ ID NO: 333)

wherein $X_{24}$ is S or N.

Group 4
| G | ISGSGVST | H |   | YADSVKG | (SEQ ID NO: 334) |
| G | ISGSGVST | Y |   | YADSVKG | (SEQ ID NO: 335) |
| A | ISGSGVST | Y |   | YADSVKG | (SEQ ID NO: 336) |
| A | ISGSGVST | N |   | YADSVKG | (SEQ ID NO: 337) |
| $X_{25}$ | ISGSGVST | $X_{26}$ |   | YADSVKG | (SEQ ID NO: 338) | wherein $X_{25}$ is G or A and $X_{26}$ is H, Y or N.

Group 5
| VIWYDGS | D | KYY | A | DSVKG | (SEQ ID NO: 339) |
| VIWYDGS | I | KYY | G | DSVKG | (SEQ ID NO: 340) |
| VIWYDGS | $X_{35}$ | KYY | $X_{36}$ | DSVKG | (SEQ ID NO: 341) | wherein $X_{35}$ is D or I and $X_{36}$ is A or G.

Group 6
| N | IY | Y | SGST | Y | YNPSLKS | (SEQ ID NO: 342) |
| R | IY | T | SGST | Y | YNPSLKS | (SEQ ID NO: 343) |
| R | IY | T | SGST | N | YNPSLKS | (SEQ ID NO: 329) |
| $X_{37}$ | IY | $X_{38}$ | SGST | $X_{41}$ | YNPSLKS | (SEQ ID NO: 344) | wherein $X_{37}$ is N or R, $X_{38}$ is Y or T and $X_{41}$ is Y or N.

Heavy CDR1

Group 1
DLSMH (SEQ ID NO: 345)

Group 2
DAWMS (SEQ ID NO: 346)

Group 3
TYAMS (SEQ ID NO: 347)

Group 4
SYFWS (SEQ ID NO: 348)

Group 5
SGGYNWS (SEQ ID NO: 349)

Group 6
NARMGV S (SEQ ID NO: 350)

NARMGV N (SEQ ID NO: 351)

NARMGV $X_{39}$ (SEQ ID NO: 352)

wherein $X_{39}$ is S or N.

Group 7
S YGIH (SEQ ID NO: 353)

N YGIH (SEQ ID NO: 354)

$X_{40}$ YGIH (SEQ ID NO: 355)

wherein $X_{40}$ is S or N.

In some cases an antigen binding protein comprises at least one heavy chain CDR1, CDR2, or CDR3 having one of the above consensus sequences. In some cases, an antigen binding protein comprises at least one light chain CDR1, CDR2, or CDR3 having one of the above consensus sequences. In other cases, the antigen binding protein comprises at least two heavy chain CDRs according to the above consensus sequences, and/or at least two light chain CDRs according to the above consensus sequences. In still other cases, the antigen binding protein comprises at least three heavy chain CDRs according to the above consensus sequences, and/or at least three light chain CDRs according to the above consensus sequences.

Exemplary Antigen Binding Proteins

According to one aspect, an isolated antigen binding protein comprising (a) one or more heavy chain complementary determining regions (CDRHs) selected from the group consisting of: (i) a CDRH1 selected from the group consisting of SEQ ID NO:121-131; (ii) a CDRH2 selected from the group consisting of SEQ ID NO:132-144; (iii) a CDRH3 selected from the group consisting of SEQ ID NO:145-157; and (iv) a CDRH of (i), (ii) and (iii) that contains one or more amino acid substitutions, deletions or insertions of no more than 1, 2, 3, 4, or 5 amino acids; (b) one or more light chain complementary determining regions (CDRLs) selected from the group consisting of: (i) a CDRL1 selected from the group consisting of SEQ ID NO:158-170; (ii) a CDRL2 selected from the group consisting of SEQ ID NO:171-179; (iii) a CDRL3 selected from the group consisting of SEQ ID NO:180-194; and (iv) a CDRL of (i), (ii) and (iii) that contains one or more amino acid substitutions, deletions or insertions of no more than five, four, three, four, two or one amino acids; or (c) one or more heavy chain CDRHs of (a) and one or more light chain CDRLs of (b).

In another embodiment, the CDRHs have at least 70%, 75%, 80%, 85%, 90%, 95%, 96%, 97%, 98% or 99% sequence identity with an amino acid sequence selected from the group consisting of SEQ ID NO:121-157, and/or the CDRLs have at least 70%, 75%, 80%, 85%, 90%, 95%, 96%, 97%, 98% or 99% sequence identity with an amino acid sequence selected from the group consisting of SEQ ID NO:158-194. In a further embodiment, the VH is selected from the group consisting of SEQ ID NO:121-157, and/or the VL is selected from the group consisting of SEQ ID NO: 158-194.

According to one aspect, an isolated antigen binding protein comprising (a) one or more variable heavy chains (VHs) selected from the group consisting of: (i) SEQ ID NO:121-157; and (ii) a VH of (i) that contains one or more amino acid substitutions, deletions or insertions of no more than five, four, three, four, two or one amino acids; (b) one or more variable light chains (VLs) selected from the group consisting of: (i) SEQ ID NO:158-194, and (ii) a VL of (i) that contains one or more amino acid substitutions, deletions or insertions of no more than five, four, three, four, two or one amino acids; or (c) one or more variable heavy chains of (a) and one or more variable light chains of (b).

In another embodiment, the variable heavy chain (VH) has at least 70%, 75%, 80%, 85%, 90%, 95%, 96%, 97%, 98% or 99% sequence identity with an amino acid sequence selected from the group consisting of SEQ ID NO:121-157, and/or the variable light chain (VL) has at least 70%, 75%, 80%, 85%, 90%, 95%, 96%, 97%, 98% or 99% sequence identity with an amino acid sequence selected from the group consisting of SEQ ID NO: 158-194.

In one aspect, also provided is an antigen binding protein that specifically binds to an epitope comprising one or more amino acid residues from FGFR1c, FGRF2c, FGFR3c, and FGFR4.

In one aspect, also provided is an antigen binding protein that specifically binds to an epitope comprising one or more amino acid residues from β-Klotho.

In another aspect, also provided is an isolated antigen binding protein that specifically binds to an epitope comprising one or more amino acid residues from both β-Klotho and one or more amino acid residues from FGFR1c, FGFR2c, FGFR3c, or FGFR4.

In yet another embodiment, the isolated antigen binding protein described hereinabove comprises a first amino acid sequence comprising at least one of the CDRH consensus sequences disclosed herein, and a second amino acid sequence comprising at least one of the CDRL consensus sequences disclosed herein.

In one aspect, the first amino acid sequence comprises at least two of the CDRH consensus sequences, and/or the second amino acid sequence comprises at least two of the CDRL consensus sequences. In certain embodiments, the first and the second amino acid sequence are covalently bonded to each other.

In a further embodiment, the first amino acid sequence of the isolated antigen binding protein comprises the CDRH3 of SEQ ID NO:146, the CDRH2 of SEQ ID NO:133, and the CDRH1 of SEQ ID NO:122, and/or the second amino acid sequence of the isolated antigen binding protein comprises the CDRL3 of SEQ ID NO:190, the CDRL2 of SEQ ID NO:176, and the CDRL1 of SEQ ID NO:167.

In a further embodiment, the first amino acid sequence of the isolated antigen binding protein comprises the CDRH3 of SEQ ID NO:147, the CDRH2 of SEQ ID NO:133, and the CDRH1 of SEQ ID NO:122, and/or the second amino acid sequence of the isolated antigen binding protein comprises the CDRL3 of SEQ ID NO:189, the CDRL2 of SEQ ID NO:176, and the CDRL1 of SEQ ID NO:167.

In a further embodiment, the first amino acid sequence of the isolated antigen binding protein comprises the CDRH3 of SEQ ID NO:148, the CDRH2 of SEQ ID NO:133, and the CDRH1 of SEQ ID NO:122, and/or the second amino acid sequence of the isolated antigen binding protein comprises the CDRL3 of SEQ ID NO:188, the CDRL2 of SEQ ID NO:176, and the CDRL1 of SEQ ID NO:166.

In a further embodiment, the first amino acid sequence of the isolated antigen binding protein comprises the CDRH3 of SEQ ID NO:148, the CDRH2 of SEQ ID NO:134, and the CDRH1 of SEQ ID NO:122, and/or the second amino acid sequence of the isolated antigen binding protein comprises the CDRL3 of SEQ ID NO:188, the CDRL2 of SEQ ID NO:176, and the CDRL1 of SEQ ID NO:166.

In a further embodiment, the first amino acid sequence of the isolated antigen binding protein comprises the CDRH3 of SEQ ID NO:150, the CDRH2 of SEQ ID NO:136, and the CDRH1 of SEQ ID NO:124, and/or the second amino acid sequence of the isolated antigen binding protein comprises the CDRL3 of SEQ ID NO:183, the CDRL2 of SEQ ID NO:174, and the CDRL1 of SEQ ID NO:161.

In a further embodiment, the first amino acid sequence of the isolated antigen binding protein comprises the CDRH3 of SEQ ID NO:152, the CDRH2 of SEQ ID NO:138, and the CDRH1 of SEQ ID NO:124, and/or the second amino acid sequence of the isolated antigen binding protein comprises the CDRL3 of SEQ ID NO:184, the CDRL2 of SEQ ID NO:173, and the CDRL1 of SEQ ID NO:162.

In a further embodiment, the first amino acid sequence of the isolated antigen binding protein comprises the CDRH3 of SEQ ID NO:152, the CDRH2 of SEQ ID NO:139, and the CDRH1 of SEQ ID NO:124, and/or the second amino acid sequence of the isolated antigen binding protein comprises the CDRL3 of SEQ ID NO:186, the CDRL2 of SEQ ID NO:173, and the CDRL1 of SEQ ID NO:162.

In a further embodiment, the first amino acid sequence of the isolated antigen binding protein comprises the CDRH3 of SEQ ID NO:151, the CDRH2 of SEQ ID NO:137, and the CDRH1 of SEQ ID NO:124, and/or the second amino acid sequence of the isolated antigen binding protein comprises the CDRL3 of SEQ ID NO:186, the CDRL2 of SEQ ID NO:173, and the CDRL1 of SEQ ID NO:164.

In a further embodiment, the first amino acid sequence of the isolated antigen binding protein comprises the CDRH3 of SEQ ID NO:151, the CDRH2 of SEQ ID NO:137, and the CDRH1 of SEQ ID NO:124, and/or the second amino acid sequence of the isolated antigen binding protein comprises the CDRL3 of SEQ ID NO:182, the CDRL2 of SEQ ID NO:173, and the CDRL1 of SEQ ID NO:160.

In a further embodiment, the first amino acid sequence of the isolated antigen binding protein comprises the CDRH3 of SEQ ID NO:153, the CDRH2 of SEQ ID NO:140, and the CDRH1 of SEQ ID NO:131, and/or the second amino acid sequence of the isolated antigen binding protein comprises the CDRL3 of SEQ ID NO:185, the CDRL2 of SEQ ID NO:173, and the CDRL1 of SEQ ID NO:163.

In a further embodiment, the first amino acid sequence of the isolated antigen binding protein comprises the CDRH3 of SEQ ID NO:153, the CDRH2 of SEQ ID NO:140, and the CDRH1 of SEQ ID NO:125, and/or the second amino acid sequence of the isolated antigen binding protein comprises the CDRL3 of SEQ ID NO:185, the CDRL2 of SEQ ID NO:173, and the CDRL1 of SEQ ID NO:163.

In a further embodiment, the first amino acid sequence of the isolated antigen binding protein comprises the CDRH3 of SEQ ID NO:149, the CDRH2 of SEQ ID NO:135, and the CDRH1 of SEQ ID NO:123, and/or the second amino acid sequence of the isolated antigen binding protein comprises the CDRL3 of SEQ ID NO:181, the CDRL2 of SEQ ID NO:172, and the CDRL1 of SEQ ID NO:159.

In a further embodiment, the first amino acid sequence of the isolated antigen binding protein comprises the CDRH3 of SEQ ID NO:149, the CDRH2 of SEQ ID NO:135, and the CDRH1 of SEQ ID NO:123, and/or the second amino acid sequence of the isolated antigen binding protein comprises the CDRL3 of SEQ ID NO:187, the CDRL2 of SEQ ID NO:175, and the CDRL1 of SEQ ID NO:165.

In a further embodiment, the first amino acid sequence of the isolated antigen binding protein comprises the CDRH3 of SEQ ID NO:145, the CDRH2 of SEQ ID NO:132, and the CDRH1 of SEQ ID NO:121, and/or the second amino acid sequence of the isolated antigen binding protein comprises the CDRL3 of SEQ ID NO:180, the CDRL2 of SEQ ID NO:171, and the CDRL1 of SEQ ID NO:158.

In a further embodiment, the first amino acid sequence of the isolated antigen binding protein comprises the CDRH3 of SEQ ID NO:154, the CDRH2 of SEQ ID NO:133, and the CDRH1 of SEQ ID NO:126, and/or the second amino acid sequence of the isolated antigen binding protein comprises the CDRL3 of SEQ ID NO:191, the CDRL2 of SEQ ID NO:171, and the CDRL1 of SEQ ID NO:168.

In a further embodiment, the first amino acid sequence of the isolated antigen binding protein comprises the CDRH3 of SEQ ID NO:157, the CDRH2 of SEQ ID NO:144, and the CDRH1 of SEQ ID NO:130, and/or the second amino acid sequence of the isolated antigen binding protein comprises the CDRL3 of SEQ ID NO:192, the CDRL2 of SEQ ID NO:177, and the CDRL1 of SEQ ID NO:169.

In a further embodiment, the first amino acid sequence of the isolated antigen binding protein comprises the CDRH3 of SEQ ID NO:155, the CDRH2 of SEQ ID NO:135, and the CDRH1 of SEQ ID NO:127, and/or the second amino acid sequence of the isolated antigen binding protein comprises the CDRL3 of SEQ ID NO:193, the CDRL2 of SEQ ID NO:178, and the CDRL1 of SEQ ID NO:170.

In a further embodiment, the first amino acid sequence of the isolated antigen binding protein comprises the CDRH3 of SEQ ID NO:156, the CDRH2 of SEQ ID NO:142, and the CDRH1 of SEQ ID NO:129, and/or the second amino acid sequence of the isolated antigen binding protein comprises the CDRL3 of SEQ ID NO:194, the CDRL2 of SEQ ID NO:173, and the CDRL1 of SEQ ID NO:163.

In a further embodiment, the first amino acid sequence of the isolated antigen binding protein comprises the CDRH3 of SEQ ID NO:156, the CDRH2 of SEQ ID NO:141, and the CDRH1 of SEQ ID NO:128, and/or the second amino acid sequence of the isolated antigen binding protein comprises the CDRL3 of SEQ ID NO:194, the CDRL2 of SEQ ID NO:173, and the CDRL1 of SEQ ID NO:163.

In a further embodiment, the first amino acid sequence of the isolated antigen binding protein comprises the CDRH3 of SEQ ID NO:156, the CDRH2 of SEQ ID NO:143, and the CDRH1 of SEQ ID NO:128, and/or the second amino acid sequence of the isolated antigen binding protein comprises the CDRL3 of SEQ ID NO:194, the CDRL2 of SEQ ID NO:179, and the CDRL1 of SEQ ID NO:163.

In a further embodiment, the antigen binding protein comprises at least two CDRH sequences of heavy chain sequences H1, H2, H3, H4, H5, H6, H7, H8, H9, H10, H11, H12, H13, H14, H15, H16, H17 or H18, as shown in Table 4A. In again a further embodiment, the antigen binding protein comprises at least two CDRL sequences of light chain sequences L1, L2, L3, L4, L5, L6, L7, L8, L9, L10, L11, L12, L13, L14, L15, L16, L17 or L18, as shown in Table 4B. In still a further embodiment, the antigen binding protein comprises at least two CDRH sequences of heavy chain sequences H1, H2, H3, H4, H5, H6, H7, H8, H9, H10, H11, H12, H13, H14, H15, H16, H17 or H18 as shown in Table 4A, and at least two CDRLs of light chain sequences L1, L2, L3, L4, L5, L6, L7, L8, L9, L10, L11, L12, L13, L14, L15, L16, L17 or L18 as shown in Table 4B.

In again another embodiment, the antigen binding protein comprises the CDRH1, CDRH2, and CDRH3 sequences of heavy chain sequences H1, H2, H3, H4, H5, H6, H7, H8, H9, H10, H11, H12, H13, H14, H15, H16, H17 or H18 as shown in Table 4A. In yet another embodiment, the antigen binding protein comprises the CDRL1, CDRL2, and CDRL3 sequences of light chain sequences L1, L2, L3, L4, L5, L6, L7, L8, L9, L10, L11, L12, L13, L14, L15, L16, L17 or L18 as shown in Table 4B.

In yet another embodiment, the antigen binding protein comprises all six CDRs of L1 and H1, or L2 and H2, or L3 and H3, or L3 and H4, or L4 and H5, or L5 and H6, or L6 and H7, or L7 and H8, or L8 and H7, or L9 and H9, or L9 and H10, or L10 and H11, or L11 and H11, or L12 and H12, or L13 and H13, or L14 and H14, or L15 and H15, or L16 and H16, or L17 and H17, or L18 and H18, as shown in Tables 4A and 4B.

TABLE 4A

Heavy Chain Sequences

| Ref | Full Heavy (H#) | Full Heavy SEQ ID NO | Variable Heavy (VH#) | Variable Heavy SEQ ID NO | CDRH1 SEQ ID NO | CDRH2 SEQ ID NO | CDRH3 SEQ ID NO |
|---|---|---|---|---|---|---|---|
| 17C3 | H1 | 30 | $V_H 1$ | 66 | 122 | 133 | 146 |
| 22H5 | H2 | 31 | $V_H 2$ | 67 | 122 | 133 | 147 |
| 16H7 | H3 | 32 | $V_H 3$ | 68 | 122 | 133 | 148 |
| 24H11 | H4 | 33 | $V_H 4$ | 69 | 122 | 134 | 148 |
| 18G1 | H5 | 34 | $V_H 5$ | 70 | 124 | 136 | 150 |

TABLE 4A-continued

Heavy Chain Sequences

| Ref | Full Heavy (H#) | Full Heavy SEQ ID NO | Variable Heavy (VH#) | Variable Heavy SEQ ID NO | CDRH1 SEQ ID NO | CDRH2 SEQ ID NO | CDRH3 SEQ ID NO |
|---|---|---|---|---|---|---|---|
| 17D8 | H6 | 35 | $V_H6$ | 71 | 124 | 138 | 152 |
| 26H11 | H7 | 36 | $V_H7$ | 72 | 124 | 139 | 152 |
| 12E4 | H8 | 37 | $V_H8$ | 73 | 124 | 137 | 151 |
| 12C11 | H7 | 37 | $V_H8$ | 73 | 124 | 137 | 151 |
| 21H2 | H9 | 38 | $V_H9$ | 74 | 131 | 140 | 153 |
| 21B4 | H10 | 39 | $V_H10$ | 75 | 125 | 140 | 153 |
| 18B11.1 | H11 | 40 | $V_H11$ | 76 | 123 | 135 | 149 |
| 18B11.2 | H11 | 40 | $V_H11$ | 77 | 123 | 135 | 149 |
| 20D4 | H12 | 41 | $V_H12$ | 78 | 121 | 132 | 145 |
| 46D11 | H13 | 42 | $V_H13$ | 79 | 126 | 133 | 154 |
| 40D2 | H14 | 46 | $V_H14$ | 80 | 130 | 144 | 157 |
| 39F7 | H16 | 44 | $V_H16$ | 82 | 129 | 142 | 156 |
| 39F11 | H17 | 43 | $V_H17$ | 83 | 128 | 141 | 156 |
| 37D3 | H15 | 47 | $V_H15$ | 81 | 127 | 135 | 155 |
| 39G5 | H18 | 45 | $V_H18$ | 84 | 128 | 143 | 156 |

TABLE 4B

Light Chain Sequences

| Ref | Full Light (L#) | Full Light SEQ ID NO | Variable Light (VH#) | Variable Light SEQ ID NO | CDRL1 SEQ ID NO | CDRL2 SEQ ID NO | CDRL3 SEQ ID NO |
|---|---|---|---|---|---|---|---|
| 17C3 | L1 | 48 | $V_L1$ | 85 | 167 | 176 | 190 |
| 22H5 | L2 | 49 | $V_L2$ | 86 | 167 | 176 | 189 |
| 16H7 | L3 | 50 | $V_L3$ | 87 | 166 | 176 | 188 |
| 24H11 | L3 | 50 | $V_L3$ | 87 | 166 | 176 | 188 |
| 18G1 | L4 | 51 | $V_L4$ | 88 | 161 | 174 | 183 |
| 17D8 | L5 | 52 | $V_L5$ | 89 | 162 | 173 | 184 |
| 26H11 | L6 | 53 | $V_L6$ | 90 | 162 | 173 | 186 |
| 12E4 | L7 | 54 | $V_L7$ | 91 | 164 | 173 | 186 |
| 12C11 | L8 | 55 | $V_L8$ | 92 | 160 | 173 | 182 |
| 21H2 | L9 | 56 | $V_L9$ | 93 | 163 | 173 | 185 |
| 21B4 | L9 | 56 | $V_L9$ | 93 | 163 | 173 | 185 |
| 18B11.1 | L10 | 57 | $V_L10$ | 94 | 159 | 172 | 181 |
| 18B11.2 | L11 | 58 | $V_L11$ | 95 | 165 | 175 | 187 |
| 20D4 | L12 | 59 | $V_L12$ | 96 | 158 | 171 | 180 |
| 46D11 | L13 | 60 | $V_L13$ | 97 | 168 | 171 | 191 |
| 40D2 | L14 | 61 | $V_L14$ | 98 | 169 | 177 | 192 |
| 39F7 | L16 | 63 | $V_L16$ | 100 | 163 | 173 | 194 |
| 37D3 | L15 | 62 | $V_L15$ | 99 | 170 | 178 | 193 |
| 39F11 | L17 | 64 | $V_L17$ | 101 | 163 | 173 | 194 |
| 39G5 | L18 | 65 | $V_L18$ | 102 | 163 | 179 | 194 |

In one aspect, the isolated antigen binding proteins that specifically bind (i) β-Klotho; (ii) FGFR1c, FGFR2c, FGFR3c or FGFR4; or (iii) a complex comprising β-Klotho and one of FGFR1c, FGFR2c, FGFR3c, and FGFR4 provided herein can be a monoclonal antibody, a polyclonal antibody, a recombinant antibody, a human antibody, a humanized antibody, a chimeric antibody, a multispecific antibody, or an antibody fragment thereof.

In another embodiment, the antibody fragment of the isolated antigen-binding proteins provided herein can be a Fab fragment, a Fab' fragment, an F(ab')$_2$ fragment, an Fv fragment, a diabody, or a single chain antibody molecule.

In a further embodiment, an isolated antigen binding protein that specifically (i) β-Klotho; (ii) FGFR1c, FGFR2c, FGFR3c or FGFR4; or (iii) a complex comprising β-Klotho and one of FGFR1c, FGFR2c, FGFR3c, and FGFR4 provided herein is a human antibody and can be of the IgG1-, IgG2-, IgG3- or IgG4-type.

In another embodiment, an isolated antigen binding protein that specifically binds (i) β-Klotho; (ii) FGFR1c, FGFR2c, FGFR3c or FGFR4; or (iii) a complex comprising β-Klotho and one of FGFR1c, FGFR2c, FGFR3c, and FGFR4 comprises a light or a heavy chain polypeptide as set forth in Tables 1A-1B. In some embodiments, an antigen binding protein that specifically binds (i) β-Klotho; (ii) FGFR1c, FGFR2c, FGFR3c or FGFR4; or (iii) a complex comprising β-Klotho and one of FGFR1c, FGFR2c, FGFR3c, and FGFR4 comprises a variable light or variable heavy domain such as those listed in Tables 2A-2B. In still other embodiments, an antigen binding protein that specifically binds (i) β-Klotho; (ii) FGFR1c, FGFR2c, FGFR3c or FGFR4; or (iii) a complex comprising β-Klotho and one of FGFR1c, FGFR2c, FGFR3c, and FGFR4 comprises one, two or three CDRHs or one, two or three CDRLs as set forth in Tables 3A-3B, 4A-4B and Table 6C, infra. Such antigen binding proteins, and indeed any of the antigen binding proteins disclosed herein, can be PEGylated with one or more PEG molecules, for examples PEG molecules having a molecular weight selected from the group consisting of 5K, 10K, 20K, 40K, 50K, 60K, 80K, 100K or greater than 100K.

In yet another aspect, any antigen binding protein that specifically binds (i) β-Klotho; (ii) FGFR1c, FGFR2c, FGFR3c or FGFR4; or (iii) a complex comprising β-Klotho and one of FGFR1c, FGFR2c, FGFR3c, and FGFR4 provided herein can be coupled to a labeling group and can compete for binding to the extracellular portion of (i) β-Klotho; (ii) FGFR1c, FGFR2c, FGFR3c or FGFR4; or (iii) a complex comprising β-Klotho and one of FGFR1c, FGFR2c, FGFR3c, and FGFR4 with an antigen binding protein of one of the isolated antigen binding proteins provided herein. In one embodiment, the isolated antigen binding protein provided herein can reduce blood glucose levels, decrease triglyceride and cholesterol levels or improve other glycemic parameters and cardiovascular risk factors when administered to a patient.

As will be appreciated, for any antigen binding protein comprising more than one CDR provided in Tables 3A-3B, and 4A-4B, any combination of CDRs independently selected from the depicted sequences may be useful. Thus, antigen binding proteins with one, two, three, four, five or six of independently selected CDRs can be generated. However, as will be appreciated by those in the art, specific embodiments generally utilize combinations of CDRs that are non-repetitive, e.g., antigen binding proteins are generally not made with two CDRH2 regions, etc.

Some of the antigen binding proteins that specifically bind (i) β-Klotho; (ii) FGFR1c, FGFR2c, FGFR3c or FGFR4; or (iii) a complex comprising β-Klotho and one of FGFR1c, FGFR2c, FGFR3c, and FGFR4 that are provided herein are discussed in more detail below.

Antigen Binding Proteins and Binding Epitopes and Binding Domains

When an antigen binding protein is said to bind an epitope on (i) β-Klotho; (ii) FGFR1c, FGFR2c, FGFR3c or FGFR4; or (iii) a complex comprising β-Klotho and one of FGFR1c, FGFR2c, FGFR3c, and FGFR4, or the extracellular domain of β-Klotho, FGFR1c, FGFR2c, FGFR3c or FGFR4, for example, what is meant is that the antigen binding protein specifically binds to a specified portion of (i) β-Klotho; (ii) FGFR1c, FGFR2c, FGFR3c or FGFR4; or (iii) a complex comprising β-Klotho and one of FGFR1c, FGFR2c, FGFR3c, and FGFR4. In some embodiments, e.g., in certain cases where the antigen binding protein binds only FGFR1c or β-Klotho, the antigen binding protein can specifically bind to a polypeptide consisting of specified residues (e.g., a specified segment of β-Klotho, FGFR1c, FGFR2c, FGFR3c or FGFR4, such as those residues disclosed in Example 14). In other embodiments, e.g., in certain cases where an antigen binding protein interacts with both β-Klotho and one or more of FGFR1c, FGFR2c, FGFR3c and FGFR4, the antigen binding protein can bind residues, sequences of residues, or regions in both β-Klotho and FGFR1c, FGFR2c, FGFR3c or FGFR4, depending on which receptor the antigen binding protein recognizes. In still other embodiments the antigen binding protein will bind residues, sequence or residues or regions of a complex comprising β-Klotho and one of FGFR1c, FGFR2c, FGFR3c, and FGFR4, for example FGFR1c.

In any of the foregoing embodiments, such an antigen binding protein does not need to contact every residue of (i) β-Klotho; (ii) FGFR1c, FGFR2c, FGFR3c or FGFR4; or (iii) a complex comprising β-Klotho and one of FGFR1c, FGFR2c, FGFR3c, and FGFR4, or the extracellular domain of the recited proteins or complexes. Nor does every single amino acid substitution or deletion within (i) β-Klotho; (ii) FGFR1c, FGFR2c, FGFR3c or FGFR4; or (iii) a complex comprising β-Klotho and one of FGFR1c, FGFR2c, FGFR3c, and FGFR4, or the extracellular domain of the recited proteins or complexes, necessarily significantly affect binding affinity.

Epitope specificity and the binding domain(s) of an antigen binding protein can be determined by a variety of methods. Some methods, for example, can use truncated portions of an antigen. Other methods utilize antigen mutated at one or more specific residues, such as by employing an alanine scanning or arginine scanning-type approach or by the generation and study of chimeric proteins in which various domains, regions or amino acids are swapped between two proteins (e.g., mouse and human forms of one or more of the antigens or target proteins), or by protease protection assays.

Competing Antigen Binding Proteins

In another aspect, antigen binding proteins are provided that compete with one of the exemplified antibodies or functional fragments for binding to (i) β-Klotho; (ii) FGFR1c, FGFR2c, FGFR3c or FGFR4; or (iii) a complex comprising β-Klotho and one of FGFR1c, FGFR2c, FGFR3c, and FGFR4. Such antigen binding proteins can also bind to the same epitope as one of the herein exemplified antigen binding proteins, or an overlapping epitope. Antigen binding proteins and fragments that compete with or bind to the same epitope as the exemplified antigen binding proteins are expected to show similar functional properties. The exemplified antigen binding proteins and fragments include those with the heavy and light chains H1-H18 and L1-L18, variable region domains $V_L1$-$V_L18$ and $V_H1$-$V_H18$, and CDRs provided herein, including those in Tables 1, 2, 3, and 4. Thus, as a specific example, the antigen binding proteins that are provided include those that compete with an antibody comprising:

(a) 1, 2, 3, 4, 5 or all 6 of the CDRs listed for an antibody listed in Tables 3A and 3B, and 4A and 4B and Table 6C, infra;

(b) a $V_H$ and a $V_L$ selected from $V_L1$-$V_L18$ and $V_H1$-$V_H18$ and listed for an antibody listed in Tables 2A and 2B; or (c) two light chains and two heavy chains as specified for an antibody listed in Tables 1A and 12B and Table 6A, infra.

Thus, in one embodiment, the present disclosure provides antigen binding proteins that competes for binding to (i) β-Klotho; (ii) FGFR1c, FGFR2c, FGFR3c or FGFR4; or (iii) a complex comprising β-Klotho and one of FGFR1c, FGFR2c, FGFR3c, and FGFR4 with a reference antibody, wherein the reference antibody comprises a combination of light chain and heavy chain variable domain sequences selected from the group consisting of L1H1, L2H2, L3H3, L3H4, L4H5, L5H6, L6H7, L7H8, L8H8, L9H9, L9H10, L10H11, L11H11, L12H12, L13H13, L14H14, L15H15, L16H16, L17H17 or L18H18. In another embodiment, the present disclosure provides human antibodies that compete for binding to (i) β-Klotho; (ii) FGFR1c, FGFR2c, FGFR3c or FGFR4; or (iii) a complex comprising β-Klotho and one of FGFR1c, FGFR2c, FGFR3c, and FGFR4 with a reference antibody, wherein the reference antibody is 17C3, 22H5, 16H7, 24H11, 18G1, 17D8, 26H11, 12E4, 12C11, 21H2, 21B4, 18B11.1, 18B11.2, 20D4, 46D11, 40D2, 37D3, 39F7, 39F1 or 39G5.

In a further embodiment, an isolated human antibody is provided that binds to (i) β-Klotho; (ii) FGFR1c, FGFR2c, FGFR3c or FGFR4; or (iii) a complex comprising β-Klotho and one of FGFR1c, FGFR2c, FGFR3c, and FGFR4 with substantially the same Kd as a reference antibody; initiates FGF21-like signaling in an in vitro ELK-Luciferase assay to the same degree as a reference antibody; lowers blood glucose; lowers serum lipid levels; and/or competes for binding with said reference antibody to (i) β-Klotho; (ii) FGFR1c, FGFR2c, FGFR3c or FGFR4; or (iii) a complex comprising β-Klotho and one of FGFR1c, FGFR2c, FGFR3c, and FGFR4, wherein the reference antibody is selected from the group consisting of 17C3, 22H5, 16H7, 24H11, 18G1, 17D8, 26H11, 12E4, 12C11, 21H2, 21B4, 18B11.1, 18B11.2, 20D4, 46D11, 40D2, 37D3, 39F7, 39F1 or 39G5.

The ability to compete with an antibody can be determined using any suitable assay, such as that described in Example 8, in which antigen binding proteins 17C3, 22H5, 16H7, 24H11, 18G1, 17D8, 26H11, 12E4, 12C11, 21H2, 21B4, 18B11.1, 18B11.2, 20D4, 46D11, 40D2, 37D3, 39F7, 39F1 or 39G5 can be used as the reference antibody.

Monoclonal Antibodies

The antigen binding proteins that are provided include monoclonal antibodies that bind to (i) β-Klotho; (ii) FGFR1c, FGFR2c, FGFR3c or FGFR4; or (iii) a complex comprising β-Klotho and one of FGFR1c, FGFR2c, FGFR3c, and FGFR4, and induce FGF21-like signaling to various degrees. Monoclonal antibodies can be produced using any technique known in the art, e.g., by immortalizing spleen cells harvested from the transgenic animal after completion of the immunization schedule. The spleen cells can be immortalized using any technique known in the art, e.g., by fusing them with myeloma cells to produce hybridomas. Myeloma cells for use in hybridoma-producing fusion procedures preferably are non-antibody-producing, have high fusion efficiency, and enzyme deficiencies that render them incapable of growing in certain selective media which support the growth of only the desired fused cells (hybridomas). Examples of suitable cell lines for use in mouse fusions include Sp-20, P3-X63/Ag8, P3-X63-Ag8.653, NS1/1.Ag 4 1, Sp210-Ag14, FO, NSO/U, MPC-11, MPC11-X45-GTG 1.7 and S194/5XXO Bul; examples of cell lines used in rat fusions include R210.RCY3, Y3-Ag 1.2.3, IR983F and 4B210. Other cell lines useful for cell fusions are U-266, GM1500-GRG2, LICR-LON-HMy2 and UC729-6.

In some instances, a hybridoma cell line is produced by immunizing an animal (e.g., a transgenic animal having human immunoglobulin sequences) with a FGFR1c, β-Klotho or FGFR1c and/or β-Klotho immunogen (e.g., a soluble complex comprising the extracellular domains of FGFR1c, FGFR2c, FGFR3c or FGFR4 and/or β-Klotho as shown in Examples 2, and 3; membranes on which the extracellular domains of FGFR1c, FGFR2c, FGFR3c or FGFR4 and/or β-Klotho are expressed, as shown in Examples 1 and 3; or whole cells expressing FGFR1c and/or β-Klotho, as shown in Examples 1 and 3); harvesting spleen cells from the immunized animal; fusing the harvested spleen cells to a myeloma cell line, thereby generating hybridoma cells; establishing hybridoma cell lines from the hybridoma cells, and identifying a hybridoma cell line that produces an antibody that binds to (i) β-Klotho; (ii) FGFR1c, FGFR2c, FGFR3c or FGFR4; or (iii) a complex comprising β-Klotho and one of FGFR1c, FGFR2c, FGFR3c, and FGFR4 (e.g., as described in the Example 4) and can induce FGF21-like signaling (e.g., as described in Examples 5-7). Such hybridoma cell lines, and the monoclonal antibodies produced by them, form aspects of the present disclosure.

Monoclonal antibodies secreted by a hybridoma cell line can be purified using any technique known in the art. Hybridomas or mAbs can be further screened to identify mAbs with particular properties, such as the ability to induce FGF21-like signaling. Examples of such screens are provided herein.

Chimeric and Humanized Antibodies

Chimeric and humanized antibodies based upon the foregoing sequences can readily be generated. One example is a chimeric antibody, which is an antibody composed of protein segments from different antibodies that are covalently joined to produce functional immunoglobulin light or heavy chains or immunologically functional portions thereof. Generally, a portion of the heavy chain and/or light chain is identical with or homologous to a corresponding sequence in antibodies derived from a particular species or belonging to a particular antibody class or subclass, while the remainder of the chain(s) is/are identical with or homologous to a corresponding sequence in antibodies derived from another species or belonging to another antibody class or subclass. For methods relating to chimeric antibodies, see, for example, U.S. Pat. No. 4,816,567; and Morrison et al., 1985, *Proc. Natl. Acad. Sci. USA* 81:6851-6855, which are hereby incorporated by reference. CDR grafting is described, for example, in U.S. Pat. Nos. 6,180,370, 5,693,762, 5,693,761, 5,585,089, and 5,530,101.

Generally, the goal of making a chimeric antibody is to create a chimera in which the number of amino acids from the intended patient/recipient species is maximized. One example is the "CDR-grafted" antibody, in which the antibody comprises one or more complementarity determining regions (CDRs) from a particular species or belonging to a particular antibody class or subclass, while the remainder of the antibody chain(s) is/are identical with or homologous to a corresponding sequence in antibodies derived from another species or belonging to another antibody class or subclass. For use in humans, the variable region or selected CDRs from a rodent antibody often are grafted into a human antibody, replacing the naturally-occurring variable regions or CDRs of the human antibody.

One useful type of chimeric antibody is a "humanized" antibody. Generally, a humanized antibody is produced from a monoclonal antibody raised initially in a non-human animal. Certain amino acid residues in this monoclonal antibody, typically from non-antigen recognizing portions of the antibody, are modified to be homologous to corresponding residues in a human antibody of corresponding isotype. Humanization can be performed, for example, using various methods by substituting at least a portion of a rodent variable region for the corresponding regions of a human antibody (see, e.g., U.S. Pat. Nos. 5,585,089, and 5,693,762; Jones et al., 1986, *Nature* 321:522-525; Riechmann et al., 1988, *Nature* 332: 323-27; Verhoeyen et al., 1988, *Science* 239:1534-1536).

In one aspect, the CDRs of the light and heavy chain variable regions of the antibodies provided herein (e.g., in Tables 3 and 4) are grafted to framework regions (FRs) from antibodies from the same, or a different, phylogenetic species. For example, the CDRs of the heavy and light chain variable regions $V_H1$, $V_H2$, $V_H3$, $V_H4$, $V_H5$, $V_H6$, $V_H7$, $V_H8$, $V_H9$, $V_H10$, $V_H11$, $V_H12$, $V_H13$, $V_H14$, $V_H15$, $V_H16$, $V_H17$ or $V_H18$ and/or $V_L1$, $V_L2$, $V_L3$, $V_L4$, $V_L5$, $V_L6$, $V_L7$, $V_L8$, $V_L9$, $V_L10$, $V_L11$, $V_H12$, $V_L13$, $V_L14$, $V_L15$, $V_L16$, $V_L17$ or $V_L18$ can be grafted to consensus human FRs. To create consensus human FRs, FRs from several human heavy chain or light chain amino acid sequences can be aligned to identify a consensus amino acid sequence. In other embodiments, the FRs of a heavy chain or light chain disclosed herein are replaced with the FRs from a different heavy chain or light chain. In one aspect, rare amino acids in the FRs of the heavy and light chains of an antigen binding protein (e.g., an antibody) that specifically binds (i) β-Klotho; (ii) FGFR1c, FGFR2c, FGFR3c or FGFR4; or (iii) a complex comprising β-Klotho and one of FGFR1c, FGFR2c, FGFR3c, and FGFR4 are not replaced, while the rest of the FR amino acids are replaced. A "rare amino acid" is a specific amino acid that is in a position in which this particular amino acid is not usually found in an FR. Alternatively, the grafted variable regions from the one heavy or light chain can be used with a constant region that is different from the constant region of that particular heavy or light chain as disclosed herein. In other embodiments, the grafted variable regions are part of a single chain Fv antibody.

In certain embodiments, constant regions from species other than human can be used along with the human variable region(s) to produce hybrid antibodies.

Fully Human Antibodies

Fully human antibodies are also provided by the instant disclosure. Methods are available for making fully human antibodies specific for a given antigen without exposing human beings to the antigen ("fully human antibodies"). One specific means provided for implementing the production of fully human antibodies is the "humanization" of the mouse humoral immune system. Introduction of human immunoglobulin (Ig) loci into mice in which the endogenous Ig genes have been inactivated is one means of producing fully human monoclonal antibodies (mAbs) in mouse, an animal that can be immunized with any desirable antigen. Using fully human antibodies can minimize the immunogenic and allergic responses that can sometimes be caused by administering mouse or mouse-derived mAbs to humans as therapeutic agents.

Fully human antibodies can be produced by immunizing transgenic animals (typically mice) that are capable of producing a repertoire of human antibodies in the absence of endogenous immunoglobulin production. Antigens for this purpose typically have six or more contiguous amino acids, and optionally are conjugated to a carrier, such as a hapten. See, e.g., Jakobovits et al., (1993) *Proc. Natl. Acad. Sci. USA* 90:2551-2555; Jakobovits et al., (1993) *Nature* 362:255-258; and Bruggermann et al., (1993) *Year in Immunol.* 7:33. In one example of such a method, transgenic animals are produced by incapacitating the endogenous mouse immunoglobulin loci encoding the mouse heavy and light immunoglobulin chains therein, and inserting into the mouse genome large fragments of human genome DNA containing loci that encode human heavy and light chain proteins. Partially modified animals, which have less than the full complement of human immunoglobulin loci, are then cross-bred to obtain an animal having all of the desired immune system modifications. When administered an immunogen, these transgenic animals produce antibodies that are immunospecific for the immunogen but have human rather than murine amino acid sequences, including the variable regions. For further details of such methods, see, e.g., WO96/33735 and WO94/02602. Additional methods relating to transgenic mice for making human antibodies are described in U.S. Pat. Nos. 5,545,807; 6,713,610; 6,673,986; 6,162,963; 5,545,807; 6,300,129; 6,255,458; 5,877,397; 5,874,299 and 5,545,806; in PCT publications WO91/10741, WO90/04036, and in EP 546073B1 and EP 546073A1.

The transgenic mice described above, referred to herein as "HuMab" mice, contain a human immunoglobulin gene minilocus that encodes unrearranged human heavy ([μ, mu] and [γ, gamma]) and [κ, kappa] light chain immunoglobulin sequences, together with targeted mutations that inactivate the endogenous μ [mu] and κ [kappa] chain loci (Lonberg et al., 1994, *Nature* 368:856-859). Accordingly, the mice exhibit reduced expression of mouse IgM or [κ, kappa] and in response to immunization, and the introduced human heavy and light chain transgenes undergo class switching and somatic mutation to generate high affinity human IgG [κ, kappa] monoclonal antibodies (Lonberg et al., supra.; Lonberg and Huszar, (1995) *Intern. Rev. Immunol.* 13: 65-93; Harding and Lonberg, (1995) *Ann. N.Y. Acad. Sci.* 764:536-546). The preparation of HuMab mice is described in detail in Taylor et al., (1992) *Nucleic Acids Research* 20:6287-6295; Chen et al., (1993) *International Immunology* 5:647-656; Tuaillon et al., (1994) *J. Immunol.* 152:2912-2920; Lonberg et al., (1994) *Nature* 368:856-859; Lonberg, (1994) *Handbook of Exp. Pharmacology* 113:49-101; Taylor et al., (1994) *International Immunology* 6:579-591; Lonberg and Huszar, (1995) *Intern. Rev. Immunol.* 13:65-93; Harding and Lonberg, (1995) *Ann. N.Y. Acad. Sci.* 764:536-546; Fishwild et al., (1996) *Nature Biotechnology* 14:845-851; the foregoing references are hereby incorporated by reference in their entirety for all purposes. See, further U.S. Pat. Nos. 5,545,806; 5,569,825; 5,625,126; 5,633,425; 5,789,650; 5,877,397; 5,661,016; 5,814,318; 5,874,299; and 5,770,429; as well as U.S. Pat. No. 5,545,807; International Publication Nos. WO 93/1227; WO 92/22646; and WO 92/03918, the disclosures of all of which are hereby incorporated by reference in their entirety for all purposes. Technologies utilized for producing human antibodies in these transgenic mice are disclosed also in WO 98/24893, and Mendez et al., (1997) *Nature Genetics* 15:146-156, which are hereby incorporated by reference. For example, the HCo7 and HCo12 transgenic mice strains can be used to generate antigen binding proteins (e.g., antibodies) that bind to (i) β-Klotho; (ii) FGFR1c, FGFR2c, FGFR3c or FGFR4; or (iii) a complex comprising β-Klotho and one of FGFR1c, FGFR2c, FGFR3c, and FGFR4 and may induce FGF21-like signaling. Further details regarding the production of human antibodies using transgenic mice are provided in the examples below.

Using hybridoma technology, antigen-specific human mAbs with the desired specificity can be produced and selected from the transgenic mice such as those described above. Such antibodies can be cloned and expressed using a suitable vector and host cell, or the antibodies can be harvested from cultured hybridoma cells.

Fully human antibodies can also be derived from phage-display libraries (as disclosed in Hoogenboom et al., (1991) *J. Mol. Biol.* 227:381; and Marks et al., (1991) *J. Mol. Biol.* 222:581). Phage display techniques mimic immune selection through the display of antibody repertoires on the surface of filamentous bacteriophage, and subsequent selection of phage by their binding to an antigen of choice. One such technique is described in PCT Publication No. WO 99/10494 (hereby incorporated by reference), which describes the isolation of high affinity and functional agonistic antibodies for MPL- and msk-receptors using such an approach.

Bispecific or Bifunctional Antigen Binding Proteins

Also provided are bispecific and bifunctional antibodies that include one or more CDRs or one or more variable regions as described above. A bispecific or bifunctional antibody in some instances can be an artificial hybrid antibody having two different heavy/light chain pairs and two different binding sites. Bispecific antibodies can be produced by a variety of methods including, but not limited to, fusion of hybridomas or linking of Fab' fragments. See, e.g., Songsivilai and Lachmann, 1990, *Clin. Exp. Immunol.* 79:315-321; Kostelny et al., 1992, *J. Immunol.* 148:1547-1553. When an antigen binding protein of the instant disclosure binds (i) both β-Klotho and one or more of FGFR1c, FGFR2c, FGFR3c or FGFR4; or (ii) a complex comprising β-Klotho and one of FGFR1c, FGFR2c, FGFR3c, and FGFR4, the binding may lead to the activation of FGF21-like activity as measured by the FGF21-like functional and signaling assays described in Examples 5-7; when such an antigen binding protein is an antibody it is referred to as an agonistic antibody.

Various Other Forms

Some of the antigen binding proteins that specifically bind (i) β-Klotho; (ii) FGFR1c, FGFR2c, FGFR3c or FGFR4; or (iii) a complex comprising β-Klotho and one of FGFR1c, FGFR2c, FGFR3c, and FGFR4 that are provided in the present disclosure include variant forms of the antigen binding proteins disclosed herein (e.g., those having the sequences listed in Tables 1-4).

In various embodiments, the antigen binding proteins disclosed herein can comprise one or more non-naturally occurring amino acids. For instance, some of the antigen binding proteins have one or more non-naturally occurring amino acid substitutions in one or more of the heavy or light chains, variable regions or CDRs listed in Tables 1-4. Examples of non-naturally amino acids (which can be substituted for any naturally-occurring amino acid found in any sequence disclosed herein, as desired) include: 4-hydroxyproline, γ-carboxyglutamate, ε-N,N,N-trimethyllysine, ε-N-acetyllysine, O-phosphoserine, N-acetylserine, N-formylmethionine, 3-methylhistidine, 5-hydroxylysine, σ-N-methylarginine, and other similar amino acids and imino acids (e.g., 4-hydroxyproline). In the polypeptide notation used herein, the left-hand direction is the amino terminal direction and the right-hand direction is the carboxyl-terminal direction, in accordance with standard usage and convention. A non-limiting lists of examples of non-naturally occurring amino acids that can be inserted into an antigen binding protein sequence or substituted for a wild-type residue in an antigen binding sequence include β-amino acids, homoamino acids, cyclic amino acids and amino acids with derivatized side chains. Examples include (in the L-form or D-form; abbreviated as in parentheses): citrulline (Cit), homocitrulline (hCit), Nα-methylcitrulline (NMeCit), Nα-methylhomocitrulline (Nα-MeHoCit), ornithine (Orn), Nα-Methylornithine (Nα-MeOrn or NMeOrn), sarcosine (Sar), homolysine (hLys or hK), homoarginine (hArg or hR), homoglutamine (hQ), Nα-methylarginine (NMeR), Nα-methylleucine (Nα-MeL or NMeL), N-methylhomolysine (NMeHoK), Nα-methylglutamine (NMeQ), norleucine (Nle), norvaline (Nva), 1,2,3,4-tetrahydroisoquinoline (Tic), Octahydroindole-2-carboxylic acid (Oic), 3-(1-naphthyl)alanine (1-Nal), 3-(2-naphthyl)alanine (2-Nal), 1,2,3,4-tetrahydroisoquinoline (Tic), 2-indanylglycine (IgI), para-iodophenylalanine (pI-Phe), para-aminophenylalanine (4AmP or 4-Amino-Phe), 4-guanidino phenylalanine (Guf), glycyllysine (abbreviated "K(Nε-glycyl)" or "K(glycyl)" or "K(gly)"), nitrophenylalanine (nitrophe), aminophenylalanine (aminophe or Amino-Phe), benzylphenylalanine (benzylphe), γ-carboxyglutamic acid (γ-carboxyglu), hydroxyproline (hydroxypro), p-carboxyl-phenylalanine (Cpa), α-aminoadipic acid (Aad), Nα-methyl valine (NMeVal), N-α-methyl leucine (NMeLeu), Nα-methylnorleucine (NMeNle), cyclopentylglycine (Cpg), cyclohexylglycine (Chg), acetylarginine (acetylarg), α, β-diaminopropionic acid (Dpr), α, γ-diaminobutyric acid (Dab), diaminopropionic acid (Dap), cyclohexylalanine (Cha), 4-methyl-phenylalanine (MePhe), β, β-diphenyl-alanine (BiPhA), aminobutyric acid (Abu), 4-phenyl-phenylalanine (or biphenylalanine; 4Bip), α-amino-isobutyric acid (Aib), beta-alanine, beta-aminopropionic acid, piperidinic acid, aminocaprioic acid, aminoheptanoic acid, aminopimelic acid, desmosine, diaminopimelic acid, N-ethylglycine, N-ethylaspargine, hydroxylysine, allo-hydroxylysine, isodesmosine, allo-isoleucine, N-methylglycine, N-methylisoleucine, N-methylvaline, 4-hydroxyproline (Hyp), γ-carboxyglutamate, ε-N,N,N-trimethyllysine, ε-N-acetyllysine, O-phosphoserine, N-acetylserine, N-formylmethionine, 3-methylhistidine, 5-hydroxylysine, ω-methylarginine, 4-Amino-O-Phthalic Acid (4APA), and other similar amino acids, and derivatized forms of any of those specifically listed.

Additionally, the antigen binding proteins can have one or more conservative amino acid substitutions in one or more of the heavy or light chains, variable regions or CDRs listed in Tables 1-4. Naturally-occurring amino acids can be divided into classes based on common side chain properties:

1) hydrophobic: norleucine, Met, Ala, Val, Leu, Ile;
2) neutral hydrophilic: Cys, Ser, Thr, Asn, Gln;
3) acidic: Asp, Glu;
4) basic: His, Lys, Arg;
5) residues that influence chain orientation: Gly, Pro; and
6) aromatic: Trp, Tyr, Phe.

Conservative amino acid substitutions can involve exchange of a member of one of these classes with another member of the same class. Conservative amino acid substitutions can encompass non-naturally occurring amino acid residues, which are typically incorporated by chemical peptide synthesis rather than by synthesis in biological systems. See Table 5, infra. These include peptidomimetics and other reversed or inverted forms of amino acid moieties.

Non-conservative substitutions can involve the exchange of a member of one of the above classes for a member from another class. Such substituted residues can be introduced into regions of the antibody that are homologous with human antibodies, or into the non-homologous regions of the molecule.

In making such changes, according to certain embodiments, the hydropathic index of amino acids can be considered. The hydropathic profile of a protein is calculated by assigning each amino acid a numerical value ("hydropathy index") and then repetitively averaging these values along the peptide chain. Each amino acid has been assigned a hydropathic index on the basis of its hydrophobicity and charge characteristics. They are: isoleucine (+4.5); valine (+4.2); leucine (+3.8); phenylalanine (+2.8); cysteine/cystine (+2.5); methionine (+1.9); alanine (+1.8); glycine (−0.4); threonine (−0.7); serine (−0.8); tryptophan (−0.9); tyrosine (−1.3); proline (−1.6); histidine (−3.2); glutamate (−3.5); glutamine (−3.5); aspartate (−3.5); asparagine (−3.5); lysine (−3.9); and arginine (−4.5).

The importance of the hydropathic profile in conferring interactive biological function on a protein is understood in the art (see, e.g., Kyte et al., 1982, J. Mol. Biol. 157:105-131). It is known that certain amino acids can be substituted for other amino acids having a similar hydropathic index or score and still retain a similar biological activity. In making changes based upon the hydropathic index, in certain embodiments, the substitution of amino acids whose hydropathic indices are within ±2 is included. In some aspects, those which are within ±1 are included, and in other aspects, those within ±0.5 are included.

It is also understood in the art that the substitution of like amino acids can be made effectively on the basis of hydrophilicity, particularly where the biologically functional protein or peptide thereby created is intended for use in immunological embodiments, as in the present case. In certain embodiments, the greatest local average hydrophilicity of a protein, as governed by the hydrophilicity of its adjacent amino acids, correlates with its immunogenicity and antigen-binding or immunogenicity, that is, with a biological property of the protein.

The following hydrophilicity values have been assigned to these amino acid residues: arginine (+3.0); lysine (+3.0); aspartate (+3.0±1); glutamate (+3.0±1); serine (+0.3); asparagine (+0.2); glutamine (+0.2); glycine (0); threonine (−0.4); proline (−0.5±1); alanine (−0.5); histidine (−0.5); cysteine (−1.0); methionine (−1.3); valine (−1.5); leucine (−1.8); isoleucine (−1.8); tyrosine (−2.3); phenylalanine (−2.5) and tryptophan (−3.4). In making changes based upon similar hydrophilicity values, in certain embodiments, the substitution of amino acids whose hydrophilicity values are within ±2 is included, in other embodiments, those which are within ±1 are included, and in still other embodiments, those within ±0.5 are included. In some instances, one can also identify epitopes from primary amino acid sequences on the basis of hydrophilicity. These regions are also referred to as "epitopic core regions."

Exemplary conservative amino acid substitutions are set forth in Table 5.

TABLE 5

Conservative Amino Acid Substitutions

| Original Residue | Exemplary Substitutions |
|---|---|
| Ala | Ser |
| Arg | Lys |
| Asn | Gln, His |
| Asp | Glu |
| Cys | Ser |
| Gln | Asn |
| Glu | Asp |
| Gly | Pro |
| His | Asn, Gln |
| Ile | Leu, Val |
| Leu | Ile, Val |
| Lys | Arg, Gln, Glu |
| Met | Leu, Ile |
| Phe | Met, Leu, Tyr |
| Ser | Thr |
| Thr | Ser |
| Trp | Tyr |
| Tyr | Trp, Phe |
| Val | Ile, Leu |

A skilled artisan will be able to determine suitable variants of polypeptides as set forth herein using well-known techniques coupled with the information provided herein. One skilled in the art can identify suitable areas of the molecule that can be changed without destroying activity by targeting regions not believed to be important for activity. The skilled artisan also will be able to identify residues and portions of the molecules that are conserved among similar polypeptides. In further embodiments, even areas that can be important for biological activity or for structure can be subject to conservative amino acid substitutions without destroying the biological activity or without adversely affecting the polypeptide structure.

Additionally, one skilled in the art can review structure-function studies identifying residues in similar polypeptides that are important for activity or structure. In view of such a comparison, one can predict the importance of amino acid residues in a protein that correspond to amino acid residues important for activity or structure in similar proteins. One skilled in the art can opt for chemically similar amino acid substitutions for such predicted important amino acid residues.

One skilled in the art can also analyze the 3-dimensional structure and amino acid sequence in relation to that structure in similar polypeptides. In view of such information, one skilled in the art can predict the alignment of amino acid residues of an antibody with respect to its three dimensional structure. One skilled in the art can choose not to make radical changes to amino acid residues predicted to be on the surface of the protein, since such residues can be involved in important interactions with other molecules. Moreover, one skilled in the art can generate test variants containing a single amino acid substitution at each desired amino acid residue. These variants can then be screened using assays for FGF21-like signaling, (see the Examples provided herein) thus yielding information regarding which amino acids can be changed and which must not be changed. In other words, based on information gathered from such routine experiments, one skilled in the art can readily determine the amino acid positions where further substitutions should be avoided either alone or in combination with other mutations.

A number of scientific publications have been devoted to the prediction of secondary structure. See, Moult, (1996) *Curr. Op. in Biotech.* 7:422-427; Chou et al., (1974) *Biochem.* 13:222-245; Chou et al., (1974) *Biochemistry* 113:211-222; Chou et al., (1978) *Adv. Enzymol. Relat. Areas Mol. Biol.* 47:45-148; Chou et al., (1979) *Ann. Rev. Biochem.* 47:251-276; and Chou et al., (1979) *Biophys. J.* 26:367-384. Moreover, computer programs are currently available to assist with predicting secondary structure. One method of predicting secondary structure is based upon homology modeling. For example, two polypeptides or proteins that have a sequence identity of greater than 30%, or similarity greater than 40% can have similar structural topologies. The growth of the protein structural database (PDB) has provided enhanced predictability of secondary structure, including the potential number of folds within a polypeptide's or protein's structure. See, Holm et al., (1999) *Nucl. Acid. Res.* 27:244-247. It has been suggested (Brenner et al., (1997) *Curr. Op. Struct. Biol.* 7:369-376) that there are a limited number of folds in a given polypeptide or protein and that once a critical number of structures have been resolved, structural prediction will become dramatically more accurate.

Additional methods of predicting secondary structure include "threading" (Jones, (1997) *Curr. Opin. Struct. Biol.* 7:377-387; Sippl et al., (1996) *Structure* 4:15-19), "profile analysis" (Bowie et al., (1991) *Science* 253:164-170; Gribskov et al., (1990) *Meth. Enzym.* 183:146-159; Gribskov et al., (1987) *Proc. Nat. Acad. Sci.* 84:4355-4358), and "evolutionary linkage" (See, Holm, (1999) supra; and Brenner, (1997) supra).

In some embodiments, amino acid substitutions are made that: (1) reduce susceptibility to proteolysis, (2) reduce susceptibility to oxidation, (3) alter binding affinity for forming protein complexes, (4) alter ligand or antigen binding affinities, and/or (4) confer or modify other physicochemical or functional properties on such polypeptides. For example, single or multiple amino acid substitutions (in certain embodiments, conservative amino acid substitutions) can be made in the naturally-occurring sequence. Substitutions can be made in that portion of the antibody that lies outside the domain(s) forming intermolecular contacts). In such embodiments, conservative amino acid substitutions can be used that do not substantially change the structural characteristics of the parent sequence (e.g., one or more replacement amino acids that do not disrupt the secondary structure that characterizes the parent or native antigen binding protein). Examples of art-recognized polypeptide secondary and tertiary structures are described in *Proteins, Structures and Molecular Principles* (Creighton, Ed.), 1984, W. H. New York: Freeman and Company; Introduction to *Protein Structure* (Branden and Tooze, eds.), 1991, New York: Garland Publishing; and Thornton et al., (1991) *Nature* 354:105, which are each incorporated herein by reference.

Additional preferred antibody variants include cysteine variants wherein one or more cysteine residues in the parent or native amino acid sequence are deleted from or substituted with another amino acid (e.g., serine). Cysteine variants are useful, inter alia when antibodies must be refolded into a biologically active conformation. Cysteine variants can have fewer cysteine residues than the native antibody, and typically have an even number to minimize interactions resulting from unpaired cysteines.

The heavy and light chains, variable regions domains and CDRs that are disclosed can be used to prepare polypeptides that contain an antigen binding region that can specifically bind (i) β-Klotho; (ii) FGFR1c, FGFR2c, FGFR3c or FGFR4; or (iii) a complex comprising β-Klotho and one of FGFR1c, FGFR2c, FGFR3c, and FGFR4 and may induce FGF21-like signaling. For example, one or more of the CDRs listed in Tables 3 and 4 can be incorporated into a molecule (e.g., a polypeptide) covalently or noncovalently to make an immunoadhesion. An immunoadhesion can incorporate the CDR(s) as part of a larger polypeptide chain, can covalently link the CDR(s) to another polypeptide chain, or can incorporate the CDR(s) noncovalently. The CDR(s) enable the immunoadhesion to bind specifically to a particular antigen of interest (e.g., (i) β-Klotho; (ii) FGFR1c, FGFR2c, FGFR3c or FGFR4; or (iii) a complex comprising β-Klotho and one of FGFR1c, FGFR2c, FGFR3c, and FGFR4 or an epitope thereon).

The heavy and light chains, variable regions domains and CDRs that are disclosed can be used to prepare polypeptides that contain an antigen binding region that can specifically bind (i) β-Klotho; (ii) FGFR1c, FGFR2c, FGFR3c or FGFR4; or (iii) a complex comprising β-Klotho and one of FGFR1c, FGFR2c, FGFR3c, and FGFR4 and may induce FGF21-like signaling. For example, one or more of the CDRs listed in Tables 3 and 4 can be incorporated into a molecule (e.g., a polypeptide) that is structurally similar to a "half" antibody comprising the heavy chain, the light chain of an antigen binding protein paired with a Fc fragment so that the antigen binding region is monovalent (like a Fab fragment) but with a dimeric Fc moiety.

Mimetics (e.g., "peptide mimetics" or "peptidomimetics") based upon the variable region domains and CDRs that are described herein are also provided. These analogs can be peptides, non-peptides or combinations of peptide and non-peptide regions. Fauchere, 1986, *Adv. Drug Res.* 15:29; Veber and Freidinger, 1985, *TINS p.* 392; and Evans et al., 1987, *J. Med. Chem.* 30:1229, which are incorporated herein by reference for any purpose. Peptide mimetics that are structurally similar to therapeutically useful peptides can be used to produce a similar therapeutic or prophylactic effect. Such compounds are often developed with the aid of computerized molecular modeling. Generally, peptidomimetics are proteins that are structurally similar to an antibody displaying a desired biological activity, such as here the ability to specifically bind (i) β-Klotho; (ii) FGFR1c, FGFR2c, FGFR3c or FGFR4; or (iii) a complex comprising β-Klotho and one of FGFR1c, FGFR2c, FGFR3c, and FGFR4, but have one or more peptide linkages optionally replaced by a linkage selected from: —$CH_2NH$—, —$CH_2S$—, —$CH_2$—$CH_2$—, —CH=CH-(cis and trans), —$COCH_2$—, —CH(OH)$CH_2$—, and —$CH_2SO$—, by methods well known in the art. Systematic substitution of one or more amino acids of a consensus sequence with a D-amino acid of the same type (e.g., D-lysine in place of L-lysine) can be used in certain embodiments to generate more stable proteins. In addition, constrained peptides comprising a consensus sequence or a substantially identical consensus sequence variation can be generated by methods known in the art (Rizo and Gierasch, 1992, *Ann. Rev. Biochem.* 61:387), incorporated herein by reference), for example, by adding internal cysteine residues capable of forming intramolecular disulfide bridges which cyclize the peptide.

Derivatives of the antigen binding proteins that specifically bind (i) β-Klotho; (ii) FGFR1c, FGFR2c, FGFR3c or FGFR4; or (iii) a complex comprising β-Klotho and one of FGFR1c, FGFR2c, FGFR3c, and FGFR4 that are described herein are also provided. The derivatized antigen binding proteins can comprise any molecule or substance that imparts a desired property to the antibody or fragment, such as increased half-life in a particular use. The derivatized antigen binding protein can comprise, for example, a detectable (or labeling) moiety (e.g., a radioactive, colorimetric, antigenic or enzymatic molecule, a detectable bead (such as a magnetic or electrodense (e.g., gold) bead), or a molecule that binds to another molecule (e.g., biotin or streptavidin)), a therapeutic or diagnostic moiety (e.g., a radioactive, cytotoxic, or pharmaceutically active moiety), or a molecule that increases the suitability of the antigen binding protein for a particular use (e.g., administration to a subject, such as a human subject, or other in vivo or in vitro uses). Examples of molecules that can be used to derivatize an antigen binding protein include albumin (e.g., human serum albumin) and polyethylene glycol (PEG). Albumin-linked and PEGylated derivatives of antigen binding proteins can be prepared using techniques well known in the art. Certain antigen binding proteins include a PEGylated single chain polypeptide as described herein. In one embodiment, the antigen binding protein is conjugated or otherwise linked to transthyretin (TTR) or a TTR variant. The TTR or TTR variant can be chemically modified with, for example, a chemical selected from the group consisting of dextran, poly(n-vinyl pyrrolidone), polyethylene glycols, propropylene glycol homopolymers, polypropylene oxide/ethylene oxide co-polymers, polyoxyethylated polyols and polyvinyl alcohols.

Other derivatives include covalent or aggregative conjugates of the antigen binding proteins that specifically bind (i) β-Klotho; (ii) FGFR1c, FGFR2c, FGFR3c or FGFR4; or (iii) a complex comprising β-Klotho and one of FGFR1c, FGFR2c, FGFR3c, and FGFR4 that are disclosed herein with other proteins or polypeptides, such as by expression of recombinant fusion proteins comprising heterologous polypeptides fused to the N-terminus or C-terminus of an antigen binding protein that induces FGF21-like signaling. For example, the conjugated peptide can be a heterologous signal (or leader) polypeptide, e.g., the yeast alpha-factor leader, or a peptide such as an epitope tag. An antigen binding protein-containing fusion protein of the present disclosure can comprise peptides added to facilitate purification or identification of an antigen binding protein that specifically binds (i) β-Klotho; (ii) FGFR1c, FGFR2c, FGFR3c or FGFR4; or (iii) a complex comprising β-Klotho and one of FGFR1c, FGFR2c, FGFR3c, and FGFR4 (e.g., a poly-His tag) and that can induce FGF21-like signaling. An antigen binding protein that specifically binds (i) β-Klotho; (ii) FGFR1c, FGFR2c, FGFR3c or FGFR4; or (iii) a complex comprising β-Klotho and one of FGFR1c, FGFR2c, FGFR3c, and FGFR4 also can be linked to the FLAG peptide as described in Hopp et al., 1988, *Bio/Technology* 6:1204; and U.S. Pat. No. 5,011,912. The FLAG peptide is highly antigenic and provides an epitope reversibly bound by a specific monoclonal antibody (mAb), enabling rapid assay and facile purification of expressed recombinant protein. Reagents useful for preparing fusion proteins in which the FLAG peptide is fused to a given polypeptide are commercially available (Sigma, St. Louis, Mo.).

Multimers that comprise one or more antigen binding proteins that specifically bind (i) β-Klotho; (ii) FGFR1c, FGFR2c, FGFR3c or FGFR4; or (iii) a complex comprising β-Klotho and one of FGFR1c, FGFR2c, FGFR3c, and FGFR4 form another aspect of the present disclosure. Multimers can take the form of covalently-linked or non-covalently-linked dimers, trimers, or higher multimers. Multimers comprising two or more antigen binding proteins that bind (i) β-Klotho; (ii) FGFR1c, FGFR2c, FGFR3c or FGFR4; or (iii) a complex comprising β-Klotho and one of FGFR1c, FGFR2c, FGFR3c, and FGFR4 and which may induce FGF21-like signaling are contemplated for use as therapeutics, diagnostics and for other uses as well, with one example of such a multimer being a homodimer. Other exemplary multimers include heterodimers, homotrimers, heterotrimers, homotetramers, heterotetramers, etc.

One embodiment is directed to multimers comprising multiple antigen binding proteins that specifically bind (i) β-Klotho; (ii) FGFR1c, FGFR2c, FGFR3c or FGFR4; or (iii) a complex comprising β-Klotho and one of FGFR1c, FGFR2c, FGFR3c, and FGFR4 joined via covalent or non-covalent interactions between peptide moieties fused to an antigen binding protein that specifically binds (i) β-Klotho; (ii) FGFR1c, FGFR2c, FGFR3c or FGFR4; or (iii) a complex comprising β-Klotho and one of FGFR1c, FGFR2c, FGFR3c, and FGFR4. Such peptides can be peptide linkers (spacers), or peptides that have the property of promoting multimerization. Leucine zippers and certain polypeptides derived from antibodies are among the peptides that can promote multimerization of antigen binding proteins attached thereto, as described in more detail herein.

In particular embodiments, the multimers comprise from two to four antigen binding proteins that bind (i) β-Klotho; (ii) FGFR1c, FGFR2c, FGFR3c or FGFR4; or (iii) a complex comprising β-Klotho and one of FGFR1c, FGFR2c, FGFR3c, and FGFR4. The antigen binding protein moieties of the multimer can be in any of the forms described above, e.g., variants or fragments. Preferably, the multimers comprise antigen binding proteins that have the ability to specifically bind (i) β-Klotho; (ii) FGFR1c, FGFR2c, FGFR3c or FGFR4; or (iii) a complex comprising β-Klotho and one of FGFR1c, FGFR2c, FGFR3c, and FGFR4.

In one embodiment, an oligomer is prepared using polypeptides derived from immunoglobulins. Preparation of fusion proteins comprising certain heterologous polypeptides fused to various portions of antibody-derived polypeptides (including the Fc domain) has been described, e.g., by Ashkenazi et al., (1991) *Proc. Natl. Acad. Sci. USA* 88:10535; Byrn et al., (1990) *Nature* 344:677; and Hollenbaugh et al., 1992 "Construction of Immunoglobulin Fusion Proteins", in *Current Protocols in Immunology*, Suppl. 4, pages 10.19.1-10.19.11.

One embodiment comprises a dimer comprising two fusion proteins created by fusing an antigen binding protein that specifically binds (i) β-Klotho; (ii) FGFR1c, FGFR2c, FGFR3c or FGFR4; or (iii) a complex comprising β-Klotho and one of FGFR1c, FGFR2c, FGFR3c, and FGFR4 to the Fc region of an antibody. The dimer can be made by, for example, inserting a gene fusion encoding the fusion protein into an appropriate expression vector, expressing the gene fusion in host cells transformed with the recombinant expression vector, and allowing the expressed fusion protein to assemble much like antibody molecules, whereupon interchain disulfide bonds form between the Fc moieties to yield the dimer.

The term "Fc polypeptide" as used herein includes native and mutein forms of polypeptides derived from the Fc region of an antibody. Truncated forms of such polypeptides containing the hinge region that promotes dimerization also are included. Fusion proteins comprising Fc moieties (and oligomers formed therefrom) offer the advantage of facile purification by affinity chromatography over Protein A or Protein G columns.

One suitable Fc polypeptide, described in PCT application WO 93/10151 and U.S. Pat. Nos. 5,426,048 and 5,262,522, is a single chain polypeptide extending from the N-terminal hinge region to the native C-terminus of the Fc region of a human IgG1 antibody. Another useful Fc polypeptide is the Fc mutein described in U.S. Pat. No. 5,457,035, and in Baum et al., (1994) *EMBO J.* 13:3992-4001. The amino acid sequence of this mutein is identical to that of the native Fc sequence presented in WO 93/10151, except that amino acid 19 has been changed from Leu to Ala, amino acid 20 has been changed from Leu to Glu, and amino acid 22 has been changed from Gly to Ala. The mutein exhibits reduced affinity for Fc receptors.

In other embodiments, the variable portion of the heavy and/or light chains of a antigen binding protein such as disclosed herein can be substituted for the variable portion of an antibody heavy and/or light chain.

Alternatively, the oligomer is a fusion protein comprising multiple antigen binding proteins that specifically bind (i) β-Klotho; (ii) FGFR1c, FGFR2c, FGFR3c or FGFR4; or (iii) a complex comprising β-Klotho and one of FGFR1c, FGFR2c, FGFR3c, and FGFR4, with or without peptide linkers (spacer peptides). Among the suitable peptide linkers are those described in U.S. Pat. Nos. 4,751,180 and 4,935,233.

Another method for preparing oligomeric derivatives comprising that antigen binding proteins that specifically bind (i) β-Klotho; (ii) FGFR1c, FGFR2c, FGFR3c or FGFR4; or (iii) a complex comprising β-Klotho and one of FGFR1c, FGFR2c, FGFR3c, and FGFR4 involves use of a leucine zipper. Leucine zipper domains are peptides that promote oligomerization of the proteins in which they are found. Leucine zippers were originally identified in several DNA-binding proteins (Landschulz et al., (1988) *Science* 240:1759), and have since been found in a variety of different proteins. Among the known leucine zippers are naturally occurring peptides and derivatives thereof that dimerize or trimerize. Examples of leucine zipper domains suitable for producing soluble oligomeric proteins are described in PCT application WO 94/10308, and the leucine zipper derived from lung surfactant protein D (SPD) described in Hoppe et al., (1994) *FEBS Letters* 344:191, hereby incorporated by reference. The use of a modified leucine zipper that allows for stable trimerization of a heterologous protein fused thereto is described in Fanslow et al., (1994) *Semin. Immunol.* 6:267-278. In one approach, recombinant fusion proteins comprising an antigen binding protein fragment or derivative that specifically binds (i) β-Klotho; (ii) FGFR1c, FGFR2c, FGFR3c or FGFR4; or (iii) a complex comprising β-Klotho and one of FGFR1c, FGFR2c, FGFR3c, and FGFR4 is fused to a leucine zipper peptide are expressed in suitable host cells, and the soluble oligomeric antigen binding protein fragments or derivatives that form are recovered from the culture supernatant.

In certain embodiments, the antigen binding protein has a $K_D$ (equilibrium binding affinity) of less than 1 pM, 10 pM, 100 pM, 1 nM, 2 nM, 5 nM, 10 nM, 25 nM or 50 nM.

In another aspect the instant disclosure provides an antigen binding protein having a half-life of at least one day in vitro or in vivo (e.g., when administered to a human subject). In one embodiment, the antigen binding protein has a half-life of at least three days. In another embodiment, the antibody or portion thereof has a half-life of four days or longer. In another embodiment, the antibody or portion thereof has a half-life of eight days or longer. In another embodiment, the antibody or portion thereof has a half-life of ten days or longer. In another embodiment, the antibody or portion thereof has a half-life of eleven days or longer. In another embodiment, the antibody or portion thereof has a half-life of fifteen days or longer. In another embodiment, the antibody or antigen-binding portion thereof is derivatized or modified such that it has a longer half-life as compared to the underivatized or unmodified antibody. In another embodiment, an antigen binding protein that specifically binds (i) β-Klotho; (ii) FGFR1c, FGFR2c, FGFR3c or FGFR4; or (iii) a complex comprising β-Klotho and one of FGFR1c, FGFR2c, FGFR3c, and FGFR4 contains point mutations to increase serum half life, such as described in WO 00/09560, published Feb. 24, 2000, incorporated by reference.

Glycosylation

An antigen binding protein that specifically binds (i) β-Klotho; (ii) FGFR1c, FGFR2c, FGFR3c or FGFR4; or (iii) a complex comprising β-Klotho and one of FGFR1c, FGFR2c, FGFR3c, and FGFR4 can have a glycosylation pattern that is different or altered from that found in the native species. As is known in the art, glycosylation patterns can depend on both the sequence of the protein (e.g., the presence or absence of particular glycosylation amino acid residues, discussed below), or the host cell or organism in which the protein is produced. Particular expression systems are discussed below.

Glycosylation of polypeptides is typically either N-linked or O-linked. N-linked refers to the attachment of the carbohydrate moiety to the side chain of an asparagine residue. The tri-peptide sequences asparagine-X-serine and asparagine-X-threonine, where X is any amino acid except proline, are the recognition sequences for enzymatic attachment of the carbohydrate moiety to the asparagine side chain. Thus, the presence of either of these tri-peptide sequences in a polypeptide creates a potential glycosylation site. O-linked glycosylation refers to the attachment of one of the sugars N-acetylgalactosamine, galactose, or xylose, to a hydroxyamino acid, most commonly serine or threonine, although 5-hydroxyproline or 5-hydroxylysine can also be used.

Addition of glycosylation sites to the antigen binding protein is conveniently accomplished by altering the amino acid sequence such that it contains one or more of the above-described tri-peptide sequences (for N-linked glycosylation sites). The alteration can also be made by the addition of, or substitution by, one or more serine or threonine residues to the starting sequence (for O-linked glycosylation sites). For ease, the antigen binding protein amino acid sequence can be altered through changes at the DNA level, particularly by mutating the DNA encoding the target polypeptide at preselected bases such that codons are generated that will translate into the desired amino acids.

Another means of increasing the number of carbohydrate moieties on the antigen binding protein is by chemical or enzymatic coupling of glycosides to the protein. These procedures are advantageous in that they do not require production of the protein in a host cell that has glycosylation capabilities for N- and O-linked glycosylation. Depending on the coupling mode used, the sugar(s) can be attached to (a) arginine and histidine, (b) free carboxyl groups, (c) free sulfhydryl groups such as those of cysteine, (d) free hydroxyl groups such as those of serine, threonine, or hydroxyproline, (e) aromatic residues such as those of phenylalanine, tyrosine, or tryptophan, or (f) the amide group of glutamine. These methods are described in WO 87/05330 and in Aplin and Wriston, (1981) *CRC Crit. Rev. Biochem.*, pp. 259-306.

Removal of carbohydrate moieties present on the starting antigen binding protein can be accomplished chemically or enzymatically. Chemical deglycosylation requires exposure of the protein to the compound trifluoromethanesulfonic acid, or an equivalent compound. This treatment results in the cleavage of most or all sugars except the linking sugar (N-acetylglucosamine or N-acetylgalactosamine), while leaving the polypeptide intact. Chemical deglycosylation is described by Hakimuddin et al., (1987) *Arch. Biochem. Biophys.* 259:52 and by Edge et al., (1981) *Anal. Biochem.* 118: 131. Enzymatic cleavage of carbohydrate moieties on polypeptides can be achieved by the use of a variety of endo- and exo-glycosidases as described by Thotakura et al., (1987) *Meth. Enzymol.* 138:350. Glycosylation at potential glycosylation sites can be prevented by the use of the compound tunicamycin as described by Duskin et al., (1982) *J. Biol. Chem.* 257:3105. Tunicamycin blocks the formation of protein-N-glycoside linkages.

Hence, aspects of the present disclosure include glycosylation variants of antigen binding proteins that specifically bind (i) β-Klotho; (ii) FGFR1c, FGFR2c, FGFR3c or FGFR4; or (iii) a complex comprising β-Klotho and one of FGFR1c, FGFR2c, FGFR3c, and FGFR4 wherein the number and/or type of glycosylation site(s) has been altered compared to the amino acid sequences of the parent polypeptide. In certain embodiments, antibody protein variants comprise a greater or a lesser number of N-linked glycosylation sites than the native antibody. An N-linked glycosylation site is characterized by the sequence: Asn-X-Ser or Asn-X-Thr, wherein the amino acid residue designated as X can be any amino acid residue except proline. The substitution of amino acid residues to create this sequence provides a potential new site for the addition of an N-linked carbohydrate chain. Alternatively, substitutions that eliminate or alter this sequence will prevent addition of an N-linked carbohydrate chain present in the native polypeptide. For example, the glycosylation can be reduced by the deletion of an Asn or by substituting the Asn with a different amino acid. In other embodiments, one or more new N-linked sites are created. Antibodies typically have a N-linked glycosylation site in the Fc region.

Labels and Effector Groups

In some embodiments, an antigen binding protein that specifically binds (i) β-Klotho; (ii) FGFR1c, FGFR2c, FGFR3c or FGFR4; or (iii) a complex comprising β-Klotho and one of FGFR1c, FGFR2c, FGFR3c, and FGFR4 comprises one or more labels. The term "labeling group" or "label" means any detectable label. Examples of suitable labeling groups include, but are not limited to the following: radioisotopes or radionuclides (e.g., $^3$H, $^{14}$C, $^{15}$N, $^{35}$S, $^{90}$Y, $^{99}$Tc, $^{111}$In, $^{125}$I, $^{131}$I), fluorescent groups (e.g., FITC, rhodamine, lanthanide phosphors), enzymatic groups (e.g., horseradish peroxidase, β-galactosidase, luciferase, alkaline phosphatase), chemiluminescent groups, biotinyl groups, or predetermined polypeptide epitopes recognized by a secondary reporter (e.g., leucine zipper pair sequences, binding sites for secondary antibodies, metal binding domains, epitope tags). In some embodiments, the labeling group is coupled to the antigen binding protein via spacer arms of various lengths to reduce potential steric hindrance. Various methods for labeling proteins are known in the art and can be used as is seen fit.

The term "effector group" means any group coupled to an antigen binding protein that specifically binds one (i) β-Klotho; (ii) FGFR1c, FGFR2c, FGFR3c or FGFR4; or (iii) a complex comprising β-Klotho and one of FGFR1c, FGFR2c, FGFR3c, and FGFR4 that acts as a cytotoxic agent. Examples for suitable effector groups are radioisotopes or radionuclides (e.g., $^3$H, $^{14}$C, $^{15}$N, $^{35}$S, $^{90}$Y, $^{99}$Tc, $^{111}$In, $^{125}$I, $^{131}$I). Other suitable groups include toxins, therapeutic groups, or chemotherapeutic groups. Examples of suitable groups include calicheamicin, auristatins, geldanamycin and cantansine. In some embodiments, the effector group is coupled to the antigen binding protein via spacer arms of various lengths to reduce potential steric hindrance.

In general, labels fall into a variety of classes, depending on the assay in which they are to be detected: a) isotopic labels, which can be radioactive or heavy isotopes; b) magnetic labels (e.g., magnetic particles); c) redox active moieties; d) optical dyes; enzymatic groups (e.g. horseradish peroxidase, β-galactosidase, luciferase, alkaline phosphatase); e) biotinylated groups; and f) predetermined polypeptide epitopes recognized by a secondary reporter (e.g., leucine zipper pair sequences, binding sites for secondary antibodies, metal binding domains, epitope tags, etc.). In some embodiments, the labeling group is coupled to the antigen binding protein via spacer arms of various lengths to reduce potential steric hindrance. Various methods for labeling proteins are known in the art.

Specific labels include optical dyes, including, but not limited to, chromophores, phosphors and fluorophores, with the latter being specific in many instances. Fluorophores can be either "small molecule" fluores, or proteinaceous fluores.

By "fluorescent label" is meant any molecule that can be detected via its inherent fluorescent properties. Suitable fluorescent labels include, but are not limited to, fluorescein, rhodamine, tetramethylrhodamine, eosin, erythrosin, coumarin, methyl-coumarins, pyrene, Malacite green, stilbene, Lucifer Yellow, Cascade Blue, Texas Red, IAEDANS, EDANS, BODIPY FL, LC Red 640, Cy 5, Cy 5.5, LC Red 705, Oregon green, the Alexa-Fluor dyes (Alexa Fluor 350, Alexa Fluor 430, Alexa Fluor 488, Alexa Fluor 546, Alexa Fluor 568, Alexa Fluor 594, Alexa Fluor 633, Alexa Fluor 647, Alexa Fluor 660, Alexa Fluor 680), Cascade Blue, Cascade Yellow and R-phycoerythrin (PE) (Molecular Probes, Eugene, Oreg.), FITC, Rhodamine, and Texas Red (Pierce, Rockford, Ill.), Cy5, Cy5.5, Cy7 (Amersham Life Science, Pittsburgh, Pa.). Suitable optical dyes, including fluorophores, are described in MOLECULAR PROBES HANDBOOK by Richard P. Haugland, hereby expressly incorporated by reference.

Suitable proteinaceous fluorescent labels also include, but are not limited to, green fluorescent protein, including a *Renilla, Ptilosarcus,* or *Aequorea* species of GFP (Chalfie et al. (1994) *Science* 263:802-805), EGFP (Clontech Labs™, Inc., Genbank™ Accession Number U55762), blue fluorescent protein (BFP, Quantum Biotechnologies, Inc.™, Quebec, Canada; Stauber, (1998) *Biotechniques* 24:462-471; Heim et al., (1996) *Curr. Biol.* 6:178-182), enhanced yellow fluorescent protein (EYFP™, Clontech Labs™, Inc.), luciferase™ (Ichiki et al., (1993) *J.Immunol.* 150:5408-5417), β galactosidase (Nolan et al., (1988) *Proc. Natl. Acad. Sci. U.S.A.* 85:2603-2607) and *Renilla* (WO92/15673, WO95/07463, WO98/14605, WO98/26277, WO99/49019, U.S. Pat. Nos. 5,292,658, 5,418,155, 5,683,888, 5,741,668, 5,777,079, 5,804,387, 5,874,304, 5,876,995, 5,925,558).

Preparing Of Antigen Binding Proteins

Non-human antibodies that are provided can be, for example, derived from any antibody-producing animal, such as mouse, rat, rabbit, goat, donkey, or non-human primate (such as monkey (e.g., *cynomolgus* or rhesus monkey) or ape (e.g., chimpanzee)). Non-human antibodies can be used, for instance, in vitro cell culture and cell-culture based applications, or any other application where an immune response to the antibody does not occur or is insignificant, can be prevented, is not a concern, or is desired. In certain embodiments, the antibodies can be produced by immunizing with full-length β-Klotho, FGFR1c, FGFR2c, FGFR3c or FGFR4 (Example 1), with the extracellular domain of β-Klotho, FGFR1c, FGFR2c, FGFR3c or FGFR4 (Example 2), or two of β-Klotho, FGFR1c, FGFR2c, FGFR3c and FGFR4 (Example 1), with whole cells expressing FGFR1c, β-Klotho or both FGFR1c and β-Klotho (Example 1 and 3), with membranes prepared from cells expressing FGFR1c, β-Klotho or both FGFR1c and β-Klotho (Example 1 and 3), with fusion proteins, e.g., Fc fusions comprising FGFR1c, β-Klotho or FGFR1c and β-Klotho (or extracellular domains thereof) fused to Fc (Example 2 and 3), and other methods known in the art, e.g., as described in the Examples presented herein. Alternatively, the certain non-human antibodies can be raised by immunizing with amino acids which are segments of one or more of β-Klotho, FGFR1c, FGFR2c, FGFR3c or FGFR4 that form part of the epitope to which certain antibodies provided herein bind. The antibodies can be polyclonal, monoclonal, or can be synthesized in host cells by expressing recombinant DNA.

Fully human antibodies can be prepared as described above by immunizing transgenic animals containing human immunoglobulin loci or by selecting a phage display library that is expressing a repertoire of human antibodies.

The monoclonal antibodies (mAbs) can be produced by a variety of techniques, including conventional monoclonal antibody methodology, e.g., the standard somatic cell hybridization technique of Kohler and Milstein, (1975) *Nature* 256: 495. Alternatively, other techniques for producing monoclonal antibodies can be employed, for example, the viral or oncogenic transformation of B-lymphocytes. One suitable animal system for preparing hybridomas is the murine system, which is a very well established procedure. Immunization protocols and techniques for isolation of immunized splenocytes for fusion are known in the art. For such procedures, B cells from immunized mice are fused with a suitable immortalized fusion partner, such as a murine myeloma cell line. If desired, rats or other mammals besides can be immunized instead of mice and B cells from such animals can be fused with the murine myeloma cell line to form hybridomas. Alternatively, a myeloma cell line from a source other than mouse can be used. Fusion procedures for making hybridomas also are well known. SLAM technology can also be employed in the production of antibodies.

The single chain antibodies that are provided can be formed by linking heavy and light chain variable domain (Fv region) fragments via an amino acid bridge (short peptide linker), resulting in a single polypeptide chain. Such single-chain Fvs (scFvs) can be prepared by fusing DNA encoding a peptide linker between DNAs encoding the two variable domain polypeptides ($V_L$ and $V_H$). The resulting polypeptides can fold back on themselves to form antigen-binding monomers, or they can form multimers (e.g., dimers, trimers, or tetramers), depending on the length of a flexible linker between the two variable domains (Kortt et al., (1997) *Prot. Eng.* 10:423; Kortt et al., (2001) *Biomol. Eng.* 18:95-108). By combining different $V_L$ and $V_H$-comprising polypeptides, one can form multimeric scFvs that bind to different epitopes (Kriangkum et al., (2001) *Biomol. Eng.* 18:31-40). Techniques developed for the production of single chain antibodies include those described in U.S. Pat. No. 4,946,778; Bird, (1988) *Science* 242:423; Huston et al., (1988) *Proc. Natl. Acad. Sci. U.S.A.* 85:5879; Ward et al., (1989) *Nature* 334: 544, de Graaf et al., (2002) *Methods Mol. Biol.* 178:379-387. Single chain antibodies derived from antibodies provided herein include, but are not limited to scFvs comprising the variable domain combinations of the heavy and light chain variable regions depicted in Table 2, or combinations of light and heavy chain variable domains which include CDRs depicted in Tables 3 and 4.

Antibodies provided herein that are of one subclass can be changed to antibodies from a different subclass using subclass switching methods. Thus, IgG antibodies can be derived from an IgM antibody, for example, and vice versa. Such techniques allow the preparation of new antibodies that possess the antigen binding properties of a given antibody (the parent antibody), but also exhibit biological properties associated with an antibody isotype or subclass different from that of the parent antibody. Recombinant DNA techniques can be employed. Cloned DNA encoding particular antibody polypeptides can be employed in such procedures, e.g., DNA encoding the constant domain of an antibody of the desired isotype. See, e.g., Lantto et al., (2002) *Methods Mol. Biol.* 178:303-316.

Accordingly, the antibodies that are provided include those comprising, for example, the variable domain combinations described, supra., having a desired isotype (for example, IgA, IgG1, IgG2, IgG3, IgG4, IgE, and IgD) as well as Fab or F(ab')$_2$ fragments thereof. Moreover, if an IgG4 is desired, it can also be desired to introduce a point mutation (CPSCP->CPPCP (SEQ ID NOS 380-381, respectively, in order of appearance)) in the hinge region as described in Bloom et al., (1997) *Protein Science* 6:407, incorporated by reference herein) to alleviate a tendency to form intra-H chain disulfide bonds that can lead to heterogeneity in the IgG4 antibodies.

Moreover, techniques for deriving antibodies having different properties (i.e., varying affinities for the antigen to which they bind) are also known. One such technique, referred to as chain shuffling, involves displaying immunoglobulin variable domain gene repertoires on the surface of filamentous bacteriophage, often referred to as phage display. Chain shuffling has been used to prepare high affinity antibodies to the hapten 2-phenyloxazol-5-one, as described by Marks et al., (1992) *BioTechnology* 10:779.

Conservative modifications can be made to the heavy and light chain variable regions described in Table 2, or the CDRs described in Tables 3A and 3B, 4A and 4B, and Table 6C, infra (and corresponding modifications to the encoding nucleic acids) to produce an antigen binding protein having functional and biochemical characteristics. Methods for achieving such modifications are described above.

Antigen binding proteins that specifically bind one or more of (i) β-Klotho; (ii) FGFR1c, FGFR2c, FGFR3c or FGFR4; or (iii) a complex comprising β-Klotho and one of FGFR1c, FGFR2c, FGFR3c, and FGFR4 can be further modified in various ways. For example, if they are to be used for therapeutic purposes, they can be conjugated with polyethylene glycol (PEGylated) to prolong the serum half-life or to enhance protein delivery. Alternatively, the V region of the subject antibodies or fragments thereof can be fused with the Fc region of a different antibody molecule. The Fc region used for this purpose can be modified so that it does not bind complement, thus reducing the likelihood of inducing cell lysis in the patient when the fusion protein is used as a therapeutic agent. In addition, the subject antibodies or functional fragments thereof can be conjugated with human serum albumin to enhance the serum half-life of the antibody or fragment thereof. Another useful fusion partner for the antigen binding proteins or fragments thereof is transthyretin (TTR). TTR has the capacity to form a tetramer, thus an antibody-TTR fusion protein can form a multivalent antibody which can increase its binding avidity.

Alternatively, substantial modifications in the functional and/or biochemical characteristics of the antigen binding proteins described herein can be achieved by creating substitutions in the amino acid sequence of the heavy and light chains that differ significantly in their effect on maintaining (a) the structure of the molecular backbone in the area of the substitution, for example, as a sheet or helical conformation, (b) the charge or hydrophobicity of the molecule at the target site, or (c) the bulkiness of the side chain. A "conservative amino acid substitution" can involve a substitution of a native amino acid residue with a normative residue that has little or no effect on the polarity or charge of the amino acid residue at that position. See, Table 5, supra. Furthermore, any native residue in the polypeptide can also be substituted with alanine, as has been previously described for alanine scanning mutagenesis.

Amino acid substitutions (whether conservative or non-conservative) of the subject antibodies can be implemented by those skilled in the art by applying routine techniques. Amino acid substitutions can be used to identify important residues of the antibodies provided herein, or to increase or decrease the affinity of these antibodies for one or more of (i) β-Klotho; (ii) FGFR1c, FGFR2c, FGFR3c or FGFR4; or (iii) a complex comprising β-Klotho and one of FGFR1c, FGFR2c, FGFR3c, and FGFR4 or for modifying the binding affinity of other antigen-binding proteins described herein.

Methods of Expressing Antigen Binding Proteins

Expression systems and constructs in the form of plasmids, expression vectors, transcription or expression cassettes that comprise at least one polynucleotide as described above are also provided herein, as well host cells comprising such expression systems or constructs.

The antigen binding proteins provided herein can be prepared by any of a number of conventional techniques. For example, antigen binding proteins that specifically bind (i) β-Klotho; (ii) FGFR1c, FGFR2c, FGFR3c or FGFR4; or (iii) a complex comprising β-Klotho and one of FGFR1c, FGFR2c, FGFR3c, and FGFR4 can be produced by recombinant expression systems, using any technique known in the art. See, e.g., Monoclonal Antibodies, Hybridomas: A New Dimension in Biological Analyses, Kennet et al. (eds.) Plenum Press, New York (1980); and Antibodies: A Laboratory Manual, Harlow and Lane (eds.), Cold Spring Harbor Laboratory Press, Cold Spring Harbor, N.Y. (1988).

Antigen binding proteins can be expressed in hybridoma cell lines (e.g., in particular antibodies can be expressed in hybridomas) or in cell lines other than hybridomas. Expression constructs encoding the antibodies can be used to transform a mammalian, insect or microbial host cell. Transformation can be performed using any known method for introducing polynucleotides into a host cell, including, for example packaging the polynucleotide in a virus or bacteriophage and transducing a host cell with the construct by transfection procedures known in the art, as exemplified by U.S. Pat. Nos. 4,399,216; 4,912,040; 4,740,461; 4,959,455. The optimal transformation procedure used will depend upon which type of host cell is being transformed. Methods for introduction of heterologous polynucleotides into mammalian cells are well known in the art and include, but are not limited to, dextran-mediated transfection, calcium phosphate precipitation, polybrene mediated transfection, protoplast fusion, electroporation, encapsulation of the polynucleotide(s) in liposomes, mixing nucleic acid with positively-charged lipids, and direct microinjection of the DNA into nuclei.

Recombinant expression constructs typically comprise a nucleic acid molecule encoding a polypeptide comprising one or more of the following: one or more CDRs provided herein; a light chain constant region; a light chain variable region; a heavy chain constant region (e.g., $C_H1$, $C_H2$ and/or C$_H$3); and/or another scaffold portion of an antigen binding protein. These nucleic acid sequences are inserted into an appropriate expression vector using standard ligation techniques. In one embodiment, the heavy or light chain constant region is appended to the C-terminus of the anti-β-Klotho, -FGFR1c, -FGFR2c, -FGFR3c, -FGFR4, or β-Klotho and FGFR1c-specific heavy or light chain variable region and is ligated into an expression vector. The vector is typically selected to be functional in the particular host cell employed (i.e., the vector is compatible with the host cell machinery, permitting amplification and/or expression of the gene can occur). In some embodiments, vectors are used that employ protein-fragment complementation assays using protein reporters, such as dihydrofolate reductase (see, for example, U.S. Pat. No. 6,270,964, which is hereby incorporated by reference). Suitable expression vectors can be purchased, for example, from Invitrogen Life Technologies or BD Biosciences (formerly "Clontech"). Other useful vectors for cloning and expressing the antibodies and fragments include those described in Bianchi and McGrew, (2003) *Biotech. Biotechnol. Bioeng.* 84:439-44, which is hereby incorporated by reference. Additional suitable expression vectors are discussed, for example, in *Methods Enzymol., vol.* 185 (D. V. Goeddel, ed.), 1990, New York: Academic Press.

Typically, expression vectors used in any of the host cells will contain sequences for plasmid maintenance and for cloning and expression of exogenous nucleotide sequences. Such sequences, collectively referred to as "flanking sequences" in certain embodiments will typically include one or more of the following nucleotide sequences: a promoter, one or more enhancer sequences, an origin of replication, a transcriptional termination sequence, a complete intron sequence containing a donor and acceptor splice site, a sequence encoding a leader sequence for polypeptide secretion, a ribosome binding site, a polyadenylation sequence, a polylinker region for inserting the nucleic acid encoding the polypeptide to be expressed, and a selectable marker element. Each of these sequences is discussed below.

Optionally, the vector can contain a "tag"-encoding sequence, i.e., an oligonucleotide molecule located at the 5' or 3' end of an antigen binding protein coding sequence; the oligonucleotide sequence encodes polyHis (such as hexaHis (SEQ ID NO: 382)), or another "tag" such as FLAG, HA (hemaglutinin influenza virus), or myc, for which commercially available antibodies exist. This tag is typically fused to the polypeptide upon expression of the polypeptide, and can serve as a means for affinity purification or detection of the antigen binding protein from the host cell. Affinity purification can be accomplished, for example, by column chromatography using antibodies against the tag as an affinity matrix. Optionally, the tag can subsequently be removed from the purified antigen binding protein by various means such as using certain peptidases for cleavage.

Flanking sequences can be homologous (i.e., from the same species and/or strain as the host cell), heterologous (i.e., from a species other than the host cell species or strain), hybrid (i.e., a combination of flanking sequences from more than one source), synthetic or native. As such, the source of a flanking sequence can be any prokaryotic or eukaryotic organism, any vertebrate or invertebrate organism, or any plant, provided that the flanking sequence is functional in, and can be activated by, the host cell machinery.

Flanking sequences useful in the vectors can be obtained by any of several methods well known in the art. Typically, flanking sequences useful herein will have been previously identified by mapping and/or by restriction endonuclease digestion and can thus be isolated from the proper tissue source using the appropriate restriction endonucleases. In some cases, the full nucleotide sequence of a flanking sequence can be known. Here, the flanking sequence can be synthesized using the methods described herein for nucleic acid synthesis or cloning.

Whether all or only a portion of the flanking sequence is known, it can be obtained using polymerase chain reaction (PCR) and/or by screening a genomic library with a suitable probe such as an oligonucleotide and/or flanking sequence fragment from the same or another species. Where the flanking sequence is not known, a fragment of DNA containing a flanking sequence can be isolated from a larger piece of DNA that can contain, for example, a coding sequence or even another gene or genes. Isolation can be accomplished by restriction endonuclease digestion to produce the proper DNA fragment followed by isolation using agarose gel purification, Qiagen® column chromatography (Chatsworth, Calif.), or other methods known to the skilled artisan. The selection of suitable enzymes to accomplish this purpose will be readily apparent to one of ordinary skill in the art.

An origin of replication is typically a part of those prokaryotic expression vectors purchased commercially, and the origin aids in the amplification of the vector in a host cell. If the vector of choice does not contain an origin of replication site, one can be chemically synthesized based on a known sequence, and ligated into the vector. For example, the origin of replication from the plasmid pBR322 (New England Biolabs, Beverly, Mass.) is suitable for most gram-negative bacteria, and various viral origins (e.g., SV40, polyoma, adenovirus, vesicular stomatitus virus (VSV), or papillomaviruses such as HPV or BPV) are useful for cloning vectors in mammalian cells. Generally, the origin of replication component is not needed for mammalian expression vectors (for example, the SV40 origin is often used only because it also contains the virus early promoter).

A transcription termination sequence is typically located 3' to the end of a polypeptide coding region and serves to terminate transcription. Usually, a transcription termination sequence in prokaryotic cells is a G-C rich fragment followed by a poly-T sequence. While the sequence is easily cloned from a library or even purchased commercially as part of a vector, it can also be readily synthesized using methods for nucleic acid synthesis such as those described herein.

A selectable marker gene encodes a protein necessary for the survival and growth of a host cell grown in a selective culture medium. Typical selection marker genes encode proteins that (a) confer resistance to antibiotics or other toxins, e.g., ampicillin, tetracycline, or kanamycin for prokaryotic host cells; (b) complement auxotrophic deficiencies of the cell; or (c) supply critical nutrients not available from complex or defined media. Specific selectable markers are the kanamycin resistance gene, the ampicillin resistance gene, and the tetracycline resistance gene. Advantageously, a neomycin resistance gene can also be used for selection in both prokaryotic and eukaryotic host cells.

Other selectable genes can be used to amplify the gene that will be expressed. Amplification is the process wherein genes that are required for production of a protein critical for growth or cell survival are reiterated in tandem within the chromosomes of successive generations of recombinant cells. Examples of suitable selectable markers for mammalian cells include dihydrofolate reductase (DHFR) and promoterless thymidine kinase genes. Mammalian cell transformants are placed under selection pressure wherein only the transformants are uniquely adapted to survive by virtue of the selectable gene present in the vector. Selection pressure is imposed by culturing the transformed cells under conditions in which the concentration of selection agent in the medium is successively increased, thereby leading to the amplification of both the selectable gene and the DNA that encodes another gene, such as an antigen binding protein that binds (i) β-Klotho; (ii) FGFR1c, FGFR2c, FGFR3c or FGFR4; or (iii) a complex comprising β-Klotho and one of FGFR1c, FGFR2c, FGFR3c, and FGFR4. As a result, increased quantities of a polypeptide such as an antigen binding protein are synthesized from the amplified DNA.

A ribosome-binding site is usually necessary for translation initiation of mRNA and is characterized by a Shine-Dalgarno sequence (prokaryotes) or a Kozak sequence (eukaryotes). The element is typically located 3' to the promoter and 5' to the coding sequence of the polypeptide to be expressed.

In some cases, such as where glycosylation is desired in a eukaryotic host cell expression system, one can manipulate the various pre- or pro-sequences to improve glycosylation or yield. For example, one can alter the peptidase cleavage site of a particular signal peptide, or add prosequences, which also can affect glycosylation. The final protein product can have, in the −1 position (relative to the first amino acid of the mature protein), one or more additional amino acids incident to expression, which may not have been totally removed. For example, the final protein product can have one or two amino acid residues found in the peptidase cleavage site, attached to the amino-terminus. Alternatively, use of some enzyme cleavage sites can result in a slightly truncated form of the desired polypeptide, if the enzyme cuts at such area within the mature polypeptide.

Expression and cloning will typically contain a promoter that is recognized by the host organism and operably linked to the molecule encoding an antigen binding protein that specifically binds (i) β-Klotho; (ii) FGFR1c, FGFR2c, FGFR3c or FGFR4; or (iii) a complex comprising β-Klotho and one of FGFR1c, FGFR2c, FGFR3c, and FGFR4. Promoters are untranscribed sequences located upstream (i.e., 5') to the start codon of a structural gene (generally within about 100 to 1000 bp) that control transcription of the structural gene. Promoters are conventionally grouped into one of two classes: inducible promoters and constitutive promoters. Inducible promoters initiate increased levels of transcription from DNA under their control in response to some change in culture conditions, such as the presence or absence of a nutrient or a change in temperature. Constitutive promoters, on the other hand, uniformly transcribe a gene to which they are operably linked, that is, with little or no control over gene expression. A large number of promoters, recognized by a variety of potential host cells, are well known. A suitable promoter is operably linked to the DNA encoding heavy chain or light chain comprising an antigen binding protein by removing the promoter from the source DNA by restriction enzyme digestion and inserting the desired promoter sequence into the vector.

Suitable promoters for use with yeast hosts are also well known in the art. Yeast enhancers are advantageously used with yeast promoters. Suitable promoters for use with mammalian host cells are well known and include, but are not limited to, those obtained from the genomes of viruses such as polyoma virus, fowlpox virus, adenovirus (such as Adenovirus 2), bovine papilloma virus, avian sarcoma virus, cytomegalovirus, retroviruses, hepatitis-B virus, and Simian Virus 40 (SV40). Other suitable mammalian promoters include heterologous mammalian promoters, for example, heat-shock promoters and the actin promoter.

Additional promoters which can be of interest include, but are not limited to: SV40 early promoter (Benoist and Chambon, (1981) *Nature* 290:304-310); CMV promoter (Thornsen et al., (1984) *Proc. Natl. Acad. U.S.A.* 81:659-663); the promoter contained in the 3' long terminal repeat of Rous sarcoma virus (Yamamoto et al., (1980) *Cell* 22:787-797); herpes thymidine kinase promoter (Wagner et al., (1981) *Proc. Natl. Acad. Sci. U.S.A.* 78:1444-1445); promoter and regulatory sequences from the metallothionine gene (Prinster et al., (1982) *Nature* 296:39-42); and prokaryotic promoters such as the beta-lactamase promoter (VIIIa-Kamaroff et al., (1978) *Proc. Natl. Acad. Sci. U.S.A.* 75:3727-3731); or the tac promoter (DeBoer et al., (1983) *Proc. Natl. Acad. Sci. U.S.A.* 80:21-25). Also of interest are the following animal transcriptional control regions, which exhibit tissue specificity and have been utilized in transgenic animals: the elastase I gene control region that is active in pancreatic acinar cells (Swift et al., (1984) *Cell* 38:639-646; Ornitz et al., (1986) *Cold Spring Harbor Symp. Quant. Biol.* 50:399-409; MacDonald, (1987) *Hepatology* 7:425-515); the insulin gene control region that is active in pancreatic beta cells (Hanahan, (1985) *Nature* 315: 115-122); the immunoglobulin gene control region that is active in lymphoid cells (Grosschedl et al., (1984) *Cell* 38:647-658; Adames et al., (1985) *Nature* 318:533-538; Alexander et al., (1987) *Mol. Cell. Biol.* 7:1436-1444); the mouse mammary tumor virus control region that is active in testicular, breast, lymphoid and mast cells (Leder et al., (1986) *Cell* 45:485-495); the albumin gene control region that is active in liver (Pinkert et al., (1987) *Genes and Devel.* 1:268-276); the alpha-feto-protein gene control region that is active in liver (Krumlauf et al., (1985) *Mol. Cell. Biol.* 5:1639-1648; Hammer et al., (1987) *Science* 253:53-58); the alpha 1-antitrypsin gene control region that is active in liver (Kelsey et al., (1987) *Genes and Devel.* 1:161-171); the beta-globin gene control region that is active in myeloid cells (Mogram et al., (1985) *Nature* 315:338-340; Kollias et al., (1986) *Cell* 46:89-94); the myelin basic protein gene control region that is active in oligodendrocyte cells in the brain (Readhead et al., (1987) *Cell* 48:703-712); the myosin light chain-2 gene control region that is active in skeletal muscle (Sani, (1985) *Nature* 314:283-286); and the gonadotropic releasing hormone gene control region that is active in the hypothalamus (Mason et al., (1986) *Science* 234:1372-1378).

An enhancer sequence can be inserted into the vector to increase transcription of DNA encoding light chain or heavy chain comprising an antigen binding protein that specifically binds (i) β-Klotho; (ii) FGFR1c, FGFR2c, FGFR3c or FGFR4; or (iii) a complex comprising β-Klotho and one of FGFR1c, FGFR2c, FGFR3c, and FGFR4 by higher eukaryotes, e.g., a human antigen binding protein that specifically binds (i) β-Klotho; (ii) FGFR1c, FGFR2c, FGFR3c or FGFR4; or (iii) a complex comprising β-Klotho and one of FGFR1c, FGFR2c, FGFR3c, and FGFR4. Enhancers are cis-acting elements of DNA, usually about 10-300 by in length, that act on the promoter to increase transcription. Enhancers are relatively orientation and position independent, having been found at positions both 5' and 3' to the transcription unit. Several enhancer sequences available from mammalian genes are known (e.g., globin, elastase, albumin, alpha-feto-protein and insulin). Typically, however, an enhancer from a virus is used. The SV40 enhancer, the cytomegalovirus early promoter enhancer, the polyoma enhancer, and adenovirus enhancers known in the art are exemplary enhancing elements for the activation of eukaryotic promoters. While an enhancer can be positioned in the vector either 5' or 3' to a coding sequence, it is typically located at a site 5' from the promoter. A sequence encoding an appropriate native or heterologous signal sequence (leader sequence or signal peptide) can be incorporated into an expression vector, to promote extracellular secretion of the antibody. The choice of signal peptide or leader depends on the type of host cells in which the antibody is to be produced, and a heterologous signal sequence can replace the native signal sequence. Examples of signal peptides that are functional in mammalian host cells include the following: the signal sequence for interleukin-7 (IL-7) described in U.S. Pat. No. 4,965,195; the signal sequence for interleukin-2 receptor described in Cosman et al., (1984) Nature 312:768; the interleukin-4 receptor signal peptide described in EP Patent No. 0367 566; the type I interleukin-1 receptor signal peptide described in U.S. Pat. No. 4,968,607; the type II interleukin-1 receptor signal peptide described in EP Patent No. 0 460 846.

The expression vectors that are provided can be constructed from a starting vector such as a commercially available vector. Such vectors can but need not contain all of the desired flanking sequences. Where one or more of the flanking sequences described herein are not already present in the vector, they can be individually obtained and ligated into the vector. Methods used for obtaining each of the flanking sequences are well known to one skilled in the art.

After the vector has been constructed and a nucleic acid molecule encoding light chain, a heavy chain, or a light chain and a heavy chain comprising an antigen binding protein that specifically binds (i) β-Klotho; (ii) FGFR1c, FGFR2c, FGFR3c or FGFR4; or (iii) a complex comprising β-Klotho and one of FGFR1c, FGFR2c, FGFR3c, and FGFR4 has been inserted into the proper site of the vector, the completed vector can be inserted into a suitable host cell for amplification and/or polypeptide expression. The transformation of an expression vector for an antigen binding protein into a selected host cell can be accomplished by well known methods including transfection, infection, calcium phosphate co-precipitation, electroporation, microinjection, lipofection, DEAE-dextran mediated transfection, or other known techniques. The method selected will in part be a function of the type of host cell to be used. These methods and other suitable methods are well known to the skilled artisan, and are set forth, for example, in Sambrook et al., (2001), supra.

A host cell, when cultured under appropriate conditions, synthesizes an antigen binding protein that can subsequently be collected from the culture medium (if the host cell secretes it into the medium) or directly from the host cell producing it (if it is not secreted). The selection of an appropriate host cell will depend upon various factors, such as desired expression levels, polypeptide modifications that are desirable or necessary for activity (such as glycosylation or phosphorylation) and ease of folding into a biologically active molecule.

Mammalian cell lines available as hosts for expression are well known in the art and include, but are not limited to, immortalized cell lines available from the American Type Culture Collection (ATCC), including but not limited to Chinese hamster ovary (CHO) cells, HeLa cells, baby hamster kidney (BHK) cells, monkey kidney cells (COS), human hepatocellular carcinoma cells (e.g., Hep G2), and a number of other cell lines. In certain embodiments, cell lines can be selected through determining which cell lines have high expression levels and constitutively produce antigen binding proteins with desirable binding properties (e.g., the ability to bind (i) β-Klotho; (ii) FGFR1c, FGFR2c, FGFR3c or FGFR4; or (iii) a complex comprising β-Klotho and one of FGFR1c, FGFR2c, FGFR3c, and FGFR4). In another embodiment, a cell line from the B cell lineage that does not make its own antibody but has a capacity to make and secrete a heterologous antibody can be selected. The ability to induce FGF21-like signaling can also form a selection criterion.

Uses of Antigen Binding Proteins for Diagnostic and Therapeutic Purposes

The antigen binding proteins disclosed herein are useful for detecting (i) β-Klotho; (ii) FGFR1c, FGFR2c, FGFR3c or FGFR4; or (iii) a complex comprising β-Klotho and one of FGFR1c, FGFR2c, FGFR3c, and FGFR4 in biological samples and identification of cells or tissues that produce one or more of (i) β-Klotho; (ii) FGFR1c, FGFR2c, FGFR3c or FGFR4; or (iii) a complex comprising β-Klotho and one of FGFR1c, FGFR2c, FGFR3c, and FGFR4. For instance, the antigen binding proteins disclosed herein can be used in diagnostic assays, e.g., binding assays to detect and/or quantify (i) β-Klotho; (ii) FGFR1c, FGFR2c, FGFR3c or FGFR4; or (iii) a complex comprising β-Klotho and one of FGFR1c, FGFR2c, FGFR3c, and FGFR4 expressed in a tissue or cell. Antigen binding proteins that specifically bind to (i) β-Klotho; (ii) FGFR1c, FGFR2c, FGFR3c or FGFR4; or (iii) a complex comprising β-Klotho and one of FGFR1c, FGFR2c, FGFR3c, and FGFR4 can be used in treatment of diseases related to FGF21-like signaling in a patient in need thereof, such as type 2 diabetes, obesity, dyslipidemia, NASH, cardiovascular disease, and metabolic syndrome. By forming a signaling complex comprising an antigen binding protein, and (i) β-Klotho; (ii) FGFR1c, FGFR2c, FGFR3c or FGFR4; or (iii) a complex comprising β-Klotho and one of FGFR1c, FGFR2c, FGFR3c, and FGFR4, the natural in vivo activity of FGF21, which associates with FGFR1c, FGFR2c, FGFR3c, FGFR4 and β-Klotho in vivo to initiate signaling, can be mimicked and/or enchanced, leading to therapeutic effects.

Indications

A disease or condition associated with human FGF21 includes any disease or condition whose onset in a patient is caused by, at least in part, the induction of FGF21-like signaling, which is initiated in vivo by the formation of a complex comprising FGFR1c, FGFR2c, FGFR3c or FGFR4 and β-Klotho and FGF21. The severity of the disease or condition can also be decreased by the induction of FGF21-like signaling. Examples of diseases and conditions that can be treated with the antigen binding proteins include type 2 diabetes, obesity, dyslipidemia, NASH, cardiovascular disease, and metabolic syndrome.

The antigen binding proteins described herein can be used to treat type 2 diabetes, obesity, dyslipidemia, NASH, cardiovascular disease, and metabolic syndrome, or can be employed as a prophylactic treatment administered, e.g., daily, weekly, biweekly, monthly, bimonthly, biannually, etc to prevent or reduce the frequency and/or severity of symptoms, e.g., elevated plasma glucose levels, elevated triglycerides and cholesterol levels, thereby providing an improved glycemic and cardiovascular risk factor profile.

Diagnostic Methods

The antigen binding proteins described herein can be used for diagnostic purposes to detect, diagnose, or monitor diseases and/or conditions associated with FGFR1c, FGFR2c, FGFR3c, FGFR4, β-Klotho, FGF21 or combinations thereof. Also provided are methods for the detection of the presence of (i) β-Klotho; (ii) FGFR1c, FGFR2c, FGFR3c or FGFR4; or (iii) a complex comprising β-Klotho and one of FGFR1c, FGFR2c, FGFR3c, and FGFR4 in a sample using classical immunohistological methods known to those of skill in the art (e.g., Tijssen, 1993, *Practice and Theory of Enzyme Immunoassays*, Vol 15 (Eds R. H. Burdon and P. H. van Knippenberg, Elsevier, Amsterdam); Zola, (1987) *Monoclonal Antibodies: A Manual of Techniques*, pp. 147-158 (CRC Press, Inc.); Jalkanen et al., (1985) *J. Cell. Biol.* 101:976-985; Jalkanen et al., (1987) *J. Cell Biol.* 105:3087-3096). The detection of (i) β-Klotho; (ii) FGFR1c, FGFR2c, FGFR3c or FGFR4; or (iii) a complex comprising β-Klotho and one of FGFR1c, FGFR2c, FGFR3c, and FGFR4 can be performed in vivo or in vitro.

Diagnostic applications provided herein include use of the antigen binding proteins to detect expression of (i) β-Klotho; (ii) FGFR1c, FGFR2c, FGFR3c or FGFR4; or (iii) a complex comprising β-Klotho and one of FGFR1c, FGFR2c, FGFR3c, and FGFR4 and/or binding to (i) β-Klotho; (ii) FGFR1c, FGFR2c, FGFR3c or FGFR4; or (iii) a complex comprising β-Klotho and one of FGFR1c, FGFR2c, FGFR3c, and FGFR4. Examples of methods useful in the detection of the presence of (i) β-Klotho; (ii) FGFR1c, FGFR2c, FGFR3c or FGFR4; or (iii) a complex comprising β-Klotho and one of FGFR1c, FGFR2c, FGFR3c, and FGFR4 include immunoassays, such as the enzyme linked immunosorbent assay (ELISA) and the radioimmunoassay (RIA).

For diagnostic applications, the antigen binding protein typically will be labeled with a detectable labeling group. Suitable labeling groups include, but are not limited to, the following: radioisotopes or radionuclides (e.g., $^3$H, $^{14}$C, $^{15}$N, $^{35}$S, $^{90}$Y, $^{99}$Tc, $^{111}$In, $^{125}$I, $^{131}$I), fluorescent groups (e.g., FITC, rhodamine, lanthanide phosphors), enzymatic groups (e.g., horseradish peroxidase, β-galactosidase, luciferase, alkaline phosphatase), chemiluminescent groups, biotinyl groups, or predetermined polypeptide epitopes recognized by a secondary reporter (e.g., leucine zipper pair sequences, binding sites for secondary antibodies, metal binding domains, epitope tags). In some embodiments, the labeling group is coupled to the antigen binding protein via spacer arms of various lengths to reduce potential steric hindrance. Various methods for labeling proteins are known in the art and can be used.

In another aspect, an antigen binding protein can be used to identify a cell or cells that express (i) β-Klotho; (ii) FGFR1c, FGFR2c, FGFR3c or FGFR4; or (iii) a complex comprising β-Klotho and one of FGFR1c, FGFR2c, FGFR3c, and FGFR4. In a specific embodiment, the antigen binding protein is labeled with a labeling group and the binding of the labeled antigen binding protein to (i) β-Klotho; (ii) FGFR1c, FGFR2c, FGFR3c or FGFR4; or (iii) a complex comprising β-Klotho and one of FGFR1c, FGFR2c, FGFR3c, and FGFR4 is detected. In a further specific embodiment, the binding of the antigen binding protein to (i) β-Klotho; (ii) FGFR1c, FGFR2c, FGFR3c or FGFR4; or (iii) a complex comprising β-Klotho and one of FGFR1c, FGFR2c, FGFR3c, and FGFR4 detected in vivo. In a further specific embodiment, the antigen binding protein is isolated and measured using techniques known in the art. See, for example, Harlow and Lane, (1988) *Antibodies: A Laboratory Manual*, New York: Cold Spring Harbor (ed. 1991 and periodic supplements); *John E. Coligan, ed.,* (1993) *Current Protocols In Immunology* New York: John Wiley & Sons.

Another aspect provides for detecting the presence of a test molecule that competes for binding to (i) β-Klotho; (ii) FGFR1c, FGFR2c, FGFR3c or FGFR4; or (iii) a complex comprising β-Klotho and one of FGFR1c, FGFR2c, FGFR3c, and FGFR4 with the antigen binding proteins provided, as disclosed herein. An example of one such assay could involve detecting the amount of free antigen binding protein in a solution containing an amount of one or more of (i) β-Klotho; (ii) FGFR1c, FGFR2c, FGFR3c or FGFR4; or (iii) a complex comprising β-Klotho and one of FGFR1c, FGFR2c, FGFR3c, and FGFR4 in the presence or absence of the test molecule. An increase in the amount of free antigen binding protein (i.e., the antigen binding protein not bound to (i) β-Klotho; (ii) FGFR1c, FGFR2c, FGFR3c or FGFR4; or (iii) a complex comprising β-Klotho and one of FGFR1c, FGFR2c, FGFR3c, and FGFR4) would indicate that the test molecule is capable of competing for binding to (i) β-Klotho; (ii) FGFR1c, FGFR2c, FGFR3c or FGFR4; or (iii) a complex comprising β-Klotho and one of FGFR1c, FGFR2c, FGFR3c, and FGFR4 with the antigen binding protein. In one embodiment, the antigen binding protein is labeled with a labeling group. Alternatively, the test molecule is labeled and the amount of free test molecule is monitored in the presence and absence of an antigen binding protein.

Methods of Treatment: Pharmaceutical Formulations and Routes of Administration

Methods of using the antigen binding proteins are also provided. In some methods, an antigen binding protein is provided to a patient. The antigen binding protein induces FGF21-like signaling.

Pharmaceutical compositions that comprise a therapeutically effective amount of one or a plurality of the antigen binding proteins and a pharmaceutically acceptable diluent, carrier, solubilizer, emulsifier, preservative, and/or adjuvant are also provided. In addition, methods of treating a patient by administering such pharmaceutical composition are included. The term "patient" includes human patients.

Acceptable formulation materials are nontoxic to recipients at the dosages and concentrations employed. In specific embodiments, pharmaceutical compositions comprising a therapeutically effective amount of human antigen binding proteins that specifically bind (i) β-Klotho; (ii) FGFR1c, FGFR2c, FGFR3c or FGFR4; or (iii) a complex comprising β-Klotho and one of FGFR1c, FGFR2c, FGFR3c, and FGFR4 are provided.

In certain embodiments, acceptable formulation materials preferably are nontoxic to recipients at the dosages and concentrations employed. In certain embodiments, the pharmaceutical composition can contain formulation materials for modifying, maintaining or preserving, for example, the pH, osmolarity, viscosity, clarity, color, isotonicity, odor, sterility, stability, rate of dissolution or release, adsorption or penetration of the composition. In such embodiments, suitable formulation materials include, but are not limited to, amino acids (such as glycine, glutamine, asparagine, arginine or lysine); antimicrobials; antioxidants (such as ascorbic acid, sodium sulfite or sodium hydrogen-sulfite); buffers (such as borate, bicarbonate, Tris-HCl, citrates, phosphates or other organic acids); bulking agents (such as mannitol or glycine); chelating agents (such as ethylenediamine tetraacetic acid (EDTA)); complexing agents (such as caffeine, polyvinylpyrrolidone, beta-cyclodextrin or hydroxypropyl-beta-cyclodextrin); fillers; monosaccharides; disaccharides; and other carbohydrates (such as glucose, mannose or dextrins); proteins (such as serum albumin, gelatin or immunoglobulins); coloring, flavoring and diluting agents; emulsifying agents; hydrophilic polymers (such as polyvinylpyrrolidone); low molecular weight polypeptides; salt-forming counterions (such as sodium); preservatives (such as benzalkonium chloride, benzoic acid, salicylic acid, thimerosal, phenethyl alcohol, methylparaben, propylparaben, chlorhexidine, sorbic acid or hydrogen peroxide); solvents (such as glycerin, propylene glycol or polyethylene glycol); sugar alcohols (such as mannitol or sorbitol); suspending agents; surfactants or wetting agents (such as Pluronics, PEG, sorbitan esters, polysorbates such as polysorbate 20, polysorbate, triton, tromethamine, lecithin, cholesterol, tyloxapal); stability enhancing agents (such as sucrose or sorbitol); tonicity enhancing agents (such as alkali metal halides, preferably sodium or potassium chloride, mannitol sorbitol); delivery vehicles; diluents; excipients and/or pharmaceutical adjuvants. See, *Remington's Pharmaceutical Sciences,* 18th Edition, (A. R. Gennaro, ed.), 1990, Mack Publishing Company.

In certain embodiments, the optimal pharmaceutical composition will be determined by one skilled in the art depending upon, for example, the intended route of administration, delivery format and desired dosage. See, for example, *Remington's Pharmaceutical Sciences,* supra. In certain embodiments, such compositions can influence the physical state, stability, rate of in vivo release and rate of in vivo clearance of the antigen binding proteins disclosed. In certain embodiments, the primary vehicle or carrier in a pharmaceutical composition can be either aqueous or non-aqueous in nature. For example, a suitable vehicle or carrier can be water for injection, physiological saline solution or artificial cerebrospinal fluid, possibly supplemented with other materials common in compositions for parenteral administration. Neutral buffered saline or saline mixed with serum albumin are further exemplary vehicles. In specific embodiments, pharmaceutical compositions comprise Tris buffer of about pH 7.0-8.5, or acetate buffer of about pH 4.0-5.5, and can further include sorbitol or a suitable substitute. In certain embodiments, compositions comprising antigen binding proteins that specifically bind (i) β-Klotho; (ii) FGFR1c, FGFR2c, FGFR3c or FGFR4; or (iii) a complex comprising β-Klotho and one of FGFR1c, FGFR2c, FGFR3c, and FGFR4 can be prepared for storage by mixing the selected composition having the desired degree of purity with optional formulation agents (*Remington's Pharmaceutical Sciences,* supra) in the form of a lyophilized cake or an aqueous solution. Further, in certain embodiments, antigen binding protein that bind (i) β-Klotho; (ii) FGFR1c, FGFR2c, FGFR3c or FGFR4; or (iii) a complex comprising β-Klotho and one of FGFR1c, FGFR2c, FGFR3c, and FGFR4 can be formulated as a lyophilizate using appropriate excipients such as sucrose.

The pharmaceutical compositions can be selected for parenteral delivery. Alternatively, the compositions can be selected for inhalation or for delivery through the digestive tract, such as orally. Preparation of such pharmaceutically acceptable compositions is within the skill of the art.

The formulation components are present preferably in concentrations that are acceptable to the site of administration. In certain embodiments, buffers are used to maintain the composition at physiological pH or at a slightly lower pH, typically within a pH range of from about 5 to about 8.

When parenteral administration is contemplated, the therapeutic compositions can be provided in the form of a pyrogen-free, parenterally acceptable aqueous solution comprising the desired antigen binding protein in a pharmaceutically acceptable vehicle. A particularly suitable vehicle for parenteral injection is sterile distilled water in which the antigen binding protein is formulated as a sterile, isotonic solution, properly preserved. In certain embodiments, the preparation can involve the formulation of the desired molecule with an agent, such as injectable microspheres, bio-erodible particles, polymeric compounds (such as polylactic acid or polyglycolic acid), beads or liposomes, that can provide controlled or sustained release of the product which can be delivered via depot injection. In certain embodiments, hyaluronic acid can also be used, which can have the effect of promoting sustained duration in the circulation. In certain embodiments, implantable drug delivery devices can be used to introduce the desired antigen binding protein.

Certain pharmaceutical compositions are formulated for inhalation. In some embodiments, antigen binding proteins that bind to (i) β-Klotho; (ii) FGFR1c, FGFR2c, FGFR3c or FGFR4; or (iii) a complex comprising β-Klotho and one of FGFR1c, FGFR2c, FGFR3c, and FGFR4 are formulated as a dry, inhalable powder. In specific embodiments, antigen binding protein inhalation solutions can also be formulated with a propellant for aerosol delivery. In certain embodiments, solutions can be nebulized. Pulmonary administration and formulation methods therefore are further described in International Patent Application No. PCT/US94/001875, which is incorporated by reference and describes pulmonary delivery of chemically modified proteins. Some formulations can be administered orally. Antigen binding proteins that specifically bind (i) β-Klotho; (ii) FGFR1c, FGFR2c, FGFR3c or FGFR4; or (iii) a complex comprising β-Klotho and one of FGFR1c, FGFR2c, FGFR3c, and FGFR4 that are administered in this fashion can be formulated with or without carriers customarily used in the compounding of solid dosage forms such as tablets and capsules. In certain embodiments, a capsule can be designed to release the active portion of the formulation at the point in the gastrointestinal tract when bioavailability is maximized and pre-systemic degradation is minimized. Additional agents can be included to facilitate absorption of an antigen binding protein. Diluents, flavorings, low melting point waxes, vegetable oils, lubricants, suspending agents, tablet disintegrating agents, and binders can also be employed.

Some pharmaceutical compositions comprise an effective quantity of one or a plurality of human antigen binding proteins that specifically bind (i) β-Klotho; (ii) FGFR1c, FGFR2c, FGFR3c or FGFR4; or (iii) a complex comprising β-Klotho and one of FGFR1c, FGFR2c, FGFR3c, and FGFR4 in a mixture with non-toxic excipients that are suitable for the manufacture of tablets. By dissolving the tablets in sterile water, or another appropriate vehicle, solutions can be prepared in unit-dose form. Suitable excipients include, but are not limited to, inert diluents, such as calcium carbonate, sodium carbonate or bicarbonate, lactose, or calcium phosphate; or binding agents, such as starch, gelatin, or acacia; or lubricating agents such as magnesium stearate, stearic acid, or talc.

Additional pharmaceutical compositions will be evident to those skilled in the art, including formulations involving antigen binding proteins that specifically bind (i) β-Klotho; (ii) FGFR1c, FGFR2c, FGFR3c or FGFR4; or (iii) a complex comprising β-Klotho and one of FGFR1c, FGFR2c, FGFR3c, and FGFR4 in sustained- or controlled-delivery formulations. Techniques for formulating a variety of other sustained- or controlled-delivery means, such as liposome carriers, bio-erodible microparticles or porous beads and depot injections, are also known to those skilled in the art. See, for example, International Patent Application No. PCT/US93/00829, which is incorporated by reference and describes controlled release of porous polymeric microparticles for delivery of pharmaceutical compositions. Sustained-release preparations can include semipermeable polymer matrices in the form of shaped articles, e.g., films, or microcapsules. Sustained release matrices can include polyesters, hydrogels, polylactides (as disclosed in U.S. Pat. No. 3,773,919 and European Patent Application Publication No. EP 058481, each of which is incorporated by reference), copolymers of L-glutamic acid and gamma ethyl-L-glutamate (Sidman et al., 1983, *Biopolymers* 2:547-556), poly (2-hydroxyethyl-inethacrylate) (Langer et al., 1981, *J. Biomed. Mater. Res.* 15:167-277 and Langer, 1982, *Chem. Tech.* 12:98-105), ethylene vinyl acetate (Langer et al., 1981, supra) or poly-D(−)-3-hydroxybutyric acid (European Patent Application Publication No. EP 133,988). Sustained release compositions can also include liposomes that can be prepared by any of several methods known in the art. See, e.g., Eppstein et al., 1985, *Proc. Natl. Acad. Sci. U.S.A.* 82:3688-3692; European Patent Application Publication Nos. EP 036,676; EP 088,046 and EP 143,949, incorporated by reference.

Pharmaceutical compositions used for in vivo administration are typically provided as sterile preparations. Sterilization can be accomplished by filtration through sterile filtration membranes. When the composition is lyophilized, sterilization using this method can be conducted either prior to or following lyophilization and reconstitution. Compositions for parenteral administration can be stored in lyophilized form or in a solution. Parenteral compositions generally are placed into a container having a sterile access port, for example, an intravenous solution bag or vial having a stopper pierceable by a hypodermic injection needle.

In certain embodiments, cells expressing a recombinant antigen binding protein as disclosed herein is encapsulated for delivery (see, *Invest. Ophthalmol Vis Sci* (2002) 43:3292-3298 and *Proc. Natl. Acad. Sciences USA* (2006) 103:3896-3901).

In certain formulations, an antigen binding protein has a concentration of at least 10 mg/ml, 20 mg/ml, 30 mg/ml, 40 mg/ml, 50 mg/ml, 60 mg/ml, 70 mg/ml, 80 mg/ml, 90 mg/ml, 100 mg/ml or 150 mg/ml. Some formulations contain a buffer, sucrose and polysorbate. An example of a formulation is one containing 50-100 mg/ml of antigen binding protein, 5-20 mM sodium acetate, 5-10% w/v sucrose, and 0.002-0.008% w/v polysorbate. Certain, formulations, for instance, contain 65-75 mg/ml of an antigen binding protein in 9-11 mM sodium acetate buffer, 8-10% w/v sucrose, and 0.005-0.006% w/v polysorbate. The pH of certain such formulations is in the range of 4.5-6. Other formulations have a pH of 5.0-5.5 (e.g., pH of 5.0, 5.2 or 5.4).

Once the pharmaceutical composition has been formulated, it can be stored in sterile vials as a solution, suspension, gel, emulsion, solid, crystal, or as a dehydrated or lyophilized powder. Such formulations can be stored either in a ready-to-use form or in a form (e.g., lyophilized) that is reconstituted prior to administration. Kits for producing a single-dose administration unit are also provided. Certain kits contain a first container having a dried protein and a second container having an aqueous formulation. In certain embodiments, kits containing single and multi-chambered pre-filled syringes (e.g., liquid syringes and lyosyringes) are provided. The therapeutically effective amount of an antigen binding protein-containing pharmaceutical composition to be employed will depend, for example, upon the therapeutic context and objectives. One skilled in the art will appreciate that the appropriate dosage levels for treatment will vary depending, in part, upon the molecule delivered, the indication for which the antigen binding protein is being used, the route of administration, and the size (body weight, body surface or organ size) and/or condition (the age and general health) of the patient. In certain embodiments, the clinician can titer the dosage and modify the route of administration to obtain the optimal therapeutic effect.

A typical dosage can range from about 1 µg/kg to up to about 30 mg/kg or more, depending on the factors mentioned above. In specific embodiments, the dosage can range from 10 µg/kg up to about 30 mg/kg, optionally from 0.1 mg/kg up to about 30 mg/kg, alternatively from 0.3 mg/kg up to about 20 mg/kg. In some applications, the dosage is from 0.5 mg/kg to 20 mg/kg. In some instances, an antigen binding protein is dosed at 0.3 mg/kg, 0.5 mg/kg, 1 mg/kg, 3 mg/kg, 10 mg/kg, or 20 mg/kg. The dosage schedule in some treatment regimes is at a dose of 0.3 mg/kg qW, 0.5 mg/kg qW, 1 mg/kg qW, 3 mg/kg qW, 10 mg/kg qW, or 20 mg/kg qW.

Dosing frequency will depend upon the pharmacokinetic parameters of the particular antigen binding protein in the formulation used. Typically, a clinician administers the composition until a dosage is reached that achieves the desired effect. The composition can therefore be administered as a single dose, or as two or more doses (which can but need not contain the same amount of the desired molecule) over time, or as a continuous infusion via an implantation device or catheter. Appropriate dosages can be ascertained through use of appropriate dose-response data. In certain embodiments, the antigen binding proteins can be administered to patients throughout an extended time period. Chronic administration of an antigen binding protein minimizes the adverse immune or allergic response commonly associated with antigen binding proteins that are not fully human, for example an antibody raised against a human antigen in a non-human animal, for example, a non-fully human antibody or non-human antibody produced in a non-human species.

The route of administration of the pharmaceutical composition is in accord with known methods, e.g., orally, through injection by intravenous, intraperitoneal, intracerebral (intraparenchymal), intracerebroventricular, intramuscular, intraocular, intraarterial, intraportal, or intralesional routes; by sustained release systems or by implantation devices. In certain embodiments, the compositions can be administered by bolus injection or continuously by infusion, or by implantation device.

The composition also can be administered locally via implantation of a membrane, sponge or another appropriate material onto which the desired molecule has been absorbed or encapsulated. In certain embodiments, where an implantation device is used, the device can be implanted into any suitable tissue or organ, and delivery of the desired molecule can be via diffusion, timed-release bolus, or continuous administration.

It also can be desirable to use antigen binding protein pharmaceutical compositions ex vivo. In such instances, cells, tissues or organs that have been removed from the patient are exposed to antigen binding protein pharmaceutical compositions after which the cells, tissues and/or organs are subsequently implanted back into the patient.

In particular, antigen binding proteins that specifically bind (i) β-Klotho; (ii) FGFR1c, FGFR2c, FGFR3c or FGFR4; or (iii) a complex comprising β-Klotho and one of FGFR1c, FGFR2c, FGFR3c, and FGFR4 can be delivered by implanting certain cells that have been genetically engineered, using methods such as those described herein, to express and secrete the polypeptide. In certain embodiments, such cells can be animal or human cells, and can be autologous, heterologous, or xenogeneic. In certain embodiments, the cells can be immortalized. In other embodiments, in order to decrease the chance of an immunological response, the cells can be encapsulated to avoid infiltration of surrounding tissues. In further embodiments, the encapsulation materials are typically biocompatible, semi-permeable polymeric enclosures or membranes that allow the release of the protein product(s) but prevent the destruction of the cells by the patient's immune system or by other detrimental factors from the surrounding tissues.

Combination Therapies

In another aspect, the present disclosure provides a method of treating a subject for diabetes with a therapeutic antigen binding protein of the present disclosure, such as the fully human therapeutic antibodies described herein, together with one or more other treatments. In one embodiment, such a combination therapy achieves an additive or synergistic effect. The antigen binding proteins can be administered in combination with one or more of the type 2 diabetes or obesity treatments currently available. These treatments for diabetes include biguanide (metaformin), and sulfonylureas (such as glyburide, glipizide). Additional treatments directed at maintaining glucose homeostasis include PPAR gamma agonists (pioglitazone, rosiglitazone); glinides (meglitinide, repaglinide, and nateglinide); DPP-4 inhibitors (Januvia® and Onglyza®) and alpha glucosidase inhibitors (acarbose, voglibose).

Additional combination treatments for diabetes include injectable treatments such as insulin and incretin mimetics (Byetta®, Exenatide®), other GLP-1 (glucagon-like peptide) analogs such as liraglutide, other GLP-1R agonists and Symlin® (pramlintide).

Additional combination treatments directed at weight loss include Meridia® and Xenical®.

EXAMPLES

The following examples, including the experiments conducted and the results achieved, are provided for illustrative purposes only and are not to be construed as limiting.

Example 1

Preparation of FGFR1c Over Expressing Cells for Use as an Antigen

Nucleic acid sequences encoding the full length human FGFR1c polypepetide (SEQ ID NO:4; FIGS. 1A-1B) and a separate sequence encoding the full length human β-Klotho polypeptide (SEQ ID NO:7; FIGS. 2A-2C) were subcloned into suitable mammalian cell expression vectors (e.g., pcDNA3.1 Zeo, pcDNA3.1 Hyg (Invitrogen, Carlsbad, Calif.) or pDSRα20. The pDSRα20 vector contains SV40 early promoter/enhancer for expressing the gene of interest and a mouse DHFR expression cassette for selection in CHO DHFR (−) host cells such as AM1 CHO (a derivative of DG44, CHO DHFR (−)).

AM-1 CHO cells were seeded at $1.5 \times 10^6$ cells per 100 mm dish. After 24 hours, the cells were co-transfected with linearized DNAs of pDSRα20/huFGFR1c and pDSRα20/huβ-Klotho with FuGene6 (Roche Applied Science). The transfected cells were trypsinized 2 days after transfection and seeded into CHO DHFR selective growth medium containing 10% dialyzed FBS and without hypoxanthine/thymidine supplement. After 2 weeks, the resulting transfected colonies were trypsinized and pooled.

HEK293T cells were transfected with the full length huFGFR1c and huβ-Klotho in pcDNA3.1 series or pTT14 (an expression vector developed by Durocher, NRCC, with CMV promoter and EBV ori, similar to pTT5 and a puromycin selection marker) based vector and selected with the corresponding drugs following similar procedure as for the CHO transfection and selection.

The FGF21R (i.e., FGFR1c and βKlotho) transfected AM1 CHO or 293T cell pools were sorted repeatedly using Alexa 647-labeled FGF21. As a cell-surface staining reagent, FGF21 was labeled with Alexa 647-NHS followed the method recommended by the manufacturer (Molecular Probes, Inc. Cat A 2006). The Alexa 647-labeled FGF21 showed specific staining of FGF21R receptor expressing cells and not the non-transfected parental cells (FIG. 3). High expressing cells were collected at the end of the final sorting, expanded and frozen into vials. The AM-1/huFGF21R cells were prepared for immunization and the 293T/huFGF21R cells were used for titering mouse sera by FACS after immunization and in binding screens of the hybridoma supernatants by FMAT (see Example 4).

Example 2

Preparation of a Soluble FGFR1c/β-Klotho Complex for Use as Antigen

Soluble FGF21 receptor constructs were generated in pTT14 or pcDNA3.1 expression vectors. The FGFR1c ECD-Fc construct (SEQ ID NO:362, FIG. 4) comprises the N-terminal extracellular domain of FGFR1c (amino acid residues #1—374; SEQ ID NO:5) fused to Fc (SEQ ID NO:384). The β-Klotho ECD-Fc construct (SEQ ID NO:363, FIG. 5) comprises the N-terminal extracellular domain of β-Klotho (amino acid residues #1-996; SEQ ID NO:8) fused to Fc (SEQ ID NO:384).

HEK293 cells (293F, Invitrogen) were transfected with huFGFR1c ECD-Fc/pTT5, huβ-Klotho ECD-Fc/pTT14-puro and dGFP/pcDNA3.1-Neo and selected in the presence of the corresponding drugs followed by repeated FACS sorting based on dGFP expression. Cells were grown in serum-free Dulbecco's Modified Eagle Medium (DMEM) supplemented with nonessential amino acids in HyperFlasks (Corning) for 4 days and conditioned media (CM) harvested for purification.

Figure 6:
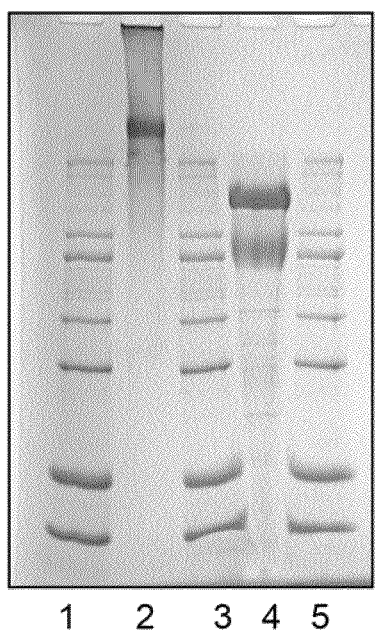
FIG. 6 is a SDS PAGE gel showing the level of purity achieved from preparations of a soluble FGF21 receptor complex comprising FGFR1c ECD-Fc and β-Klotho ECD-Fc, which was employed as an immunogen to generate antigen binding proteins.
Figure 7A:
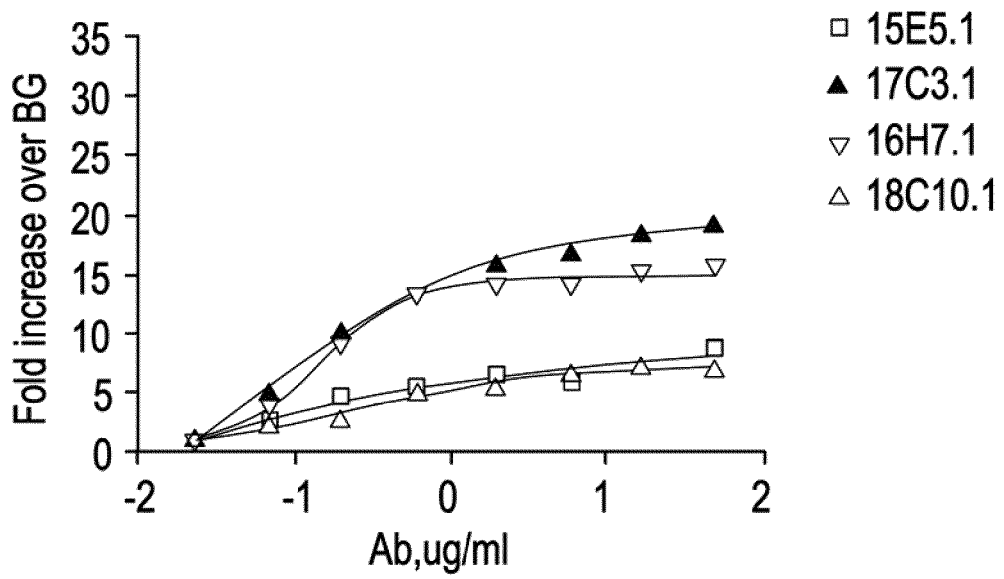
FIGS. 7A-D are a series of plots generated from an ELK-luciferase reporter assay as described herein performed on recombinant CHO clone 2E10, demonstrating the ability of some of the antigen binding proteins to induce FGF21-like signaling in recombinant CHO cells expressing a FGF21 receptor complex comprising FGFR1c and β-Klotho.
Figure 7B:
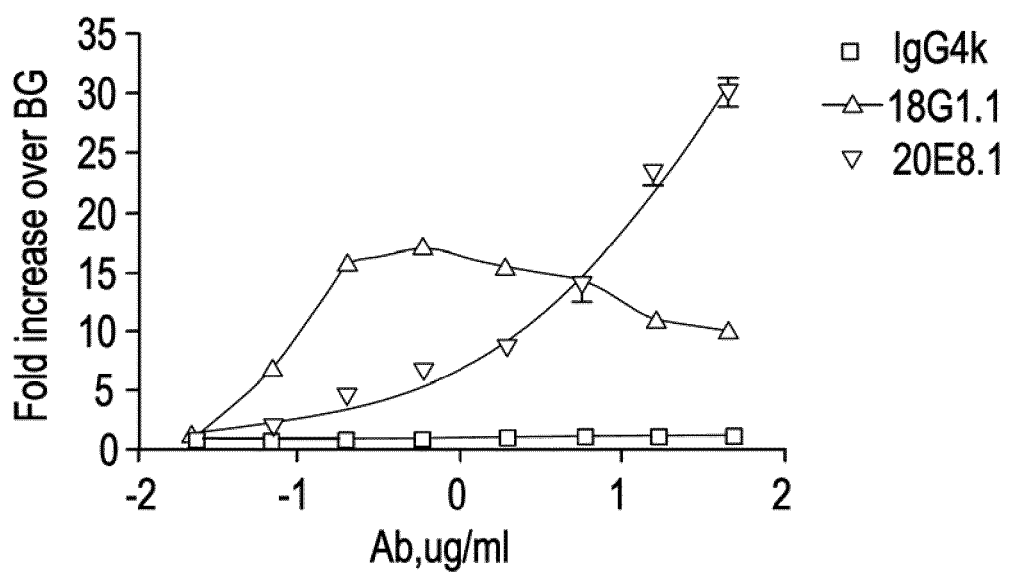
Figure 7C:
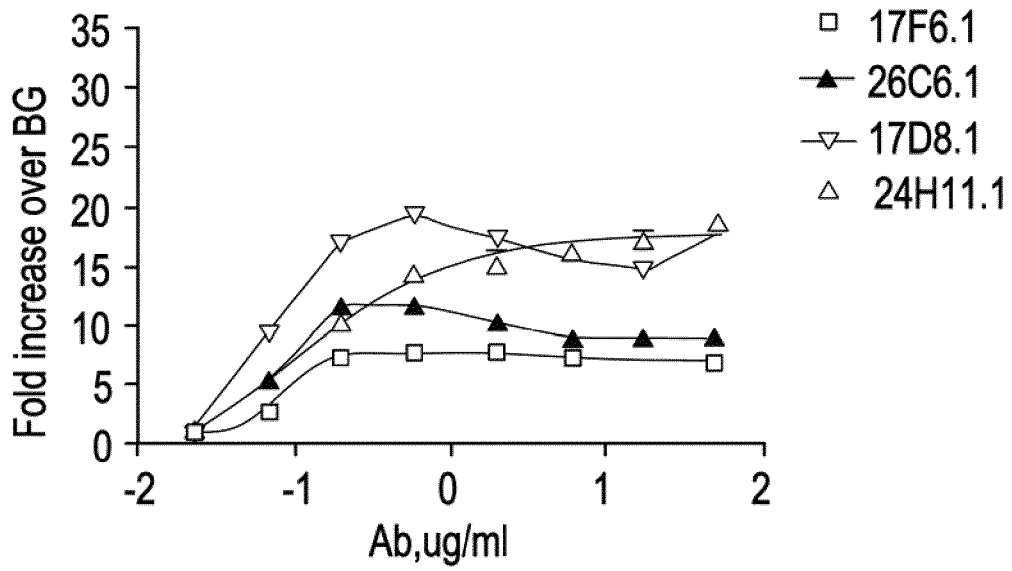
Figure 7D:
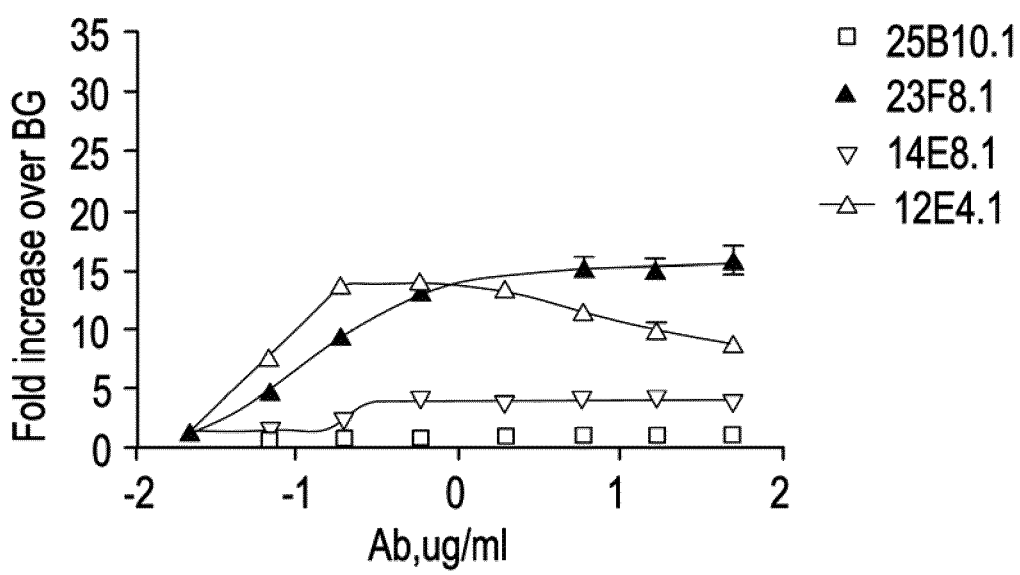

The 293 CM was concentrated 6 fold and applied to Protein A FF equilibrated in PBS. The protein was eluted with Pierce Gentle Ag/Ab elution buffer. The Protein A pool was dialyzed against 20 mM Tris-HCl, pH 7, 10 mM NaCl and applied to SP HP at pH 7.0. The FGFR1c ECD-Fc was present in the flow-through (FT) and the heterodimer was eluted with linear gradient of 0-0.4 M NaCl, 20 mM Tris-HCl pH 7.0. N-terminus amino acid sequencing verified the purified soluble FGF21R to be a heterodimer composed of (1:1) ratio of FGFR1c ECD-Fc and β-Klotho ECD-Fc. The purified soluble FGF21R-Fc (FIG. 6) was used as the antigen for immunization.

Example 3

Preparation of Monoclonal Antibodies

Immunizations were conducted using one or more suitable forms of FGF21 receptor antigen, including: (1) cell bound receptor of CHO transfectants expressing full length human FGFR1c and β-Klotho at the cell surface, obtained by transfecting CHO cells with cDNA encoding a human full length FGFR1c polypeptide of SEQ ID NO:4 (see also FIGS. 1a-b) and cDNA encoding a human β-Klotho polypeptide of SEQ ID NO:7 (see also FIGS. 2a-c); (2) membrane extract from the aforementioned cells expressing the FGF21R receptor complex; or (3) soluble FGF21R receptor obtainable by co-expressing the N-terminal extracellular domain (ECD) of FGFR1c (SEQ ID NO:5; see also FIG. 4) and the N-terminal extracellular domain (ECD) of β-Klotho (SEQ ID NO:8; see also FIG. 5) or (4) combinations thereof.

A suitable amount of immunogen (i.e., 10 μgs/mouse of soluble FGF21R or $3-4 \times 10^6$ cells/mouse of stably transfected CHO cells or 150 μgs/mouse of purified FGF21R membranes prepared from CHO cells stably expressing FGF21R) was used for initial immunization in XenoMouse™ according to the methods disclosed in U.S. patent application Ser. No. 08/759,620, filed Dec. 3, 1996 and International Patent Application Nos. WO 98/24893, and WO 00/76310, the disclosures of which are hereby incorporated by reference. Following the initial immunization, subsequent boost immunizations of immunogen (5 µg/mouse of soluble FGF21R or 1.7×10⁶ FGF21R transfected cells/mouse or 75 µgs of purified FGF21R membranes) were administered on a schedule and for the duration necessary to induce a suitable anti-FGF21R titer in the mice. Titers were determined by a suitable method, for example, by enzyme immunoassay, fluorescence activated cell sorting (FACS), or by other methods (including combinations of enzyme immunoassays and FACS).

Animals exhibiting suitable titers were identified, and lymphocytes were obtained from draining lymph nodes and, if necessary, pooled for each cohort. Lymphocytes were dissociated from lymphoid tissue by grinding in a suitable medium (for example, Dulbecco's Modified Eagle Medium; DMEM; obtainable from Invitrogen, Carlsbad, Calif.) to release the cells from the tissues, and suspended in DMEM. B cells were selected and/or expanded using standard methods, and fused with suitable fusion partner, for example, nonsecretory myeloma P3X63Ag8.653 cells (American Type Culture Collection CRL1580; Kearney et al, *J. Immunol.* 123, 1979, 1548-1550), using techniques that were known in the art.

In one suitable fusion method, lymphocytes were mixed with fusion partner cells at a ratio of 1:4. The cell mixture was gently pelleted by centrifugation at 400×g for 4 minutes, the supernatant decanted, and the cell mixture gently mixed (for example, by using a 1 ml pipette). Fusion was induced with PEG/DMSO (polyethylene glycol/dimethyl sulfoxide; obtained from Sigma-Aldrich, St. Louis Mo.; 1 ml per million of lymphocytes). PEG/DMSO was slowly added with gentle agitation over one minute followed, by one minute of mixing. IDMEM (DMEM without glutamine; 2 ml per million of B cells), was then added over 2 minutes with gentle agitation, followed by additional IDMEM (8 ml per million B-cells) which was added over 3 minutes.

The fused cells were pelleted (400×g 6 minutes) and resuspended in 20 ml Selection media (for example, DMEM containing Azaserine and Hypoxanthine [HA] and other supplemental materials as necessary) per million B-cells. Cells were incubated for 20-30 minutes at 37° C. and then resuspended in 200 ml selection media and cultured for three to four days in T175 flasks prior to 96 well plating.

Cells were distributed into 96-well plates using standard techniques to maximize clonality of the resulting colonies. After several days of culture, supernatants were collected and subjected to screening assays as detailed in the examples below, including confirmation of binding to human FGF21 receptor, specificity and/or cross-species reactivity. Positive cells were further selected and subjected to standard cloning and subcloning techniques. Clonal lines were expanded in vitro, and the secreted human antibodies obtained for analysis.

In this manner, mice were immunized with either cells or membranes expressing full length FGF21R cells, or soluble FGF21R extracellular domain, with a range of 11-17 immunizations over a period of approximately one to three and one-half months. Several cell lines secreting FGF21R-specific antibodies were obtained, and the antibodies were further characterized. The sequences thereof are presented herein and in the Sequence Listing, and results of various tests using these antibodies are provided.

Example 4

Selection of Binding Antibodies by FMAT

After 14 days of culture, hybridoma supernatants were screened for FGF21R-specific monoclonal antibodies by Fluorometric Microvolume Assay Technology (FMAT) by screening against either the CHO AM1/huFGF21R cell line or recombinant HEK293 cells that were transfected with human FGF21R and counter-screening against parental CHO or HEK293 cells. Briefly the cells in Freestyle media (Invitrogen) were seeded into 384-well FMAT plates in a volume of 50 µL/well at a density of 4,000 cells/well for the stable transfectants, and at a density of 16,000 cells/well for the parental cells, and cells were incubated overnight at 37° C. 10 µL/well of supernatant was then added, and the plates were incubated for approximately one hour at 4° C., after which 10 µL/well of anti-human IgG-Cy5 secondary antibody was added at a concentration of 2.8 µg/ml (400 ng/ml final concentration). Plates were then incubated for one hour at 4° C., and fluorescence was read using an FMAT Cellular Detection System (Applied Biosystems).

In total, over 3,000 hybridoma supernatants were identified as binding to the FGF21 receptor expressing cells but not to parental cells by the FMAT method. These supernatants were then tested in the FGF21 functional assays as described below.

Example 5

Selection of Antibodies that Induce FGF21-Like Signaling

Experiments were performed to identify functional antibodies that mimic wild-type FGF21 activity (e.g., the ability to induce FGF21-like signaling) using a suitable FGF21 reporter assay. The disclosed FGF21 reporter assay measures activation of FGFR signaling via a MAPK pathway readout. β-Klotho is a co-receptor for FGF21 signaling, and although it is believed not to have any inherent signaling capability due to its very short cytoplasmic domain, it is required for FGF21 to induce signaling through FGFRs.

Example 5.1

ELK-Luciferase Reporter Assay

ELK-luciferase assays were performed using a recombinant human 293T kidney cell or CHO cell system. Specifically, the host cells were engineered to over-express β-Klotho and luciferase reporter constructs. The reporter constructs contain sequences encoding GAL4-ELK1 and 5×UAS-Luc, a luciferase reporter driven by a promoter containing five tandem copies of the Gal4 binding site. Activation of the FGF21 receptor complex in these recombinant reporter cell lines induces intracellular signal transduction, which in turn leads to ERK and ELK phosphorylation. Luciferase activity is regulated by the level of phosphorylated ELK, and is used to indirectly monitor and quantify FGF21 activity.

In one example, CHO cells were transfected sequentially using the Lipofectamine 2000 transfection reagent (Invitrogen) according to the manufacturer's protocol with the receptor constructs expressing β-Klotho, FGFR1c and the reporter plasmids: 5× Gal4-Luciferase (minimal TK promoter with 5×Gal4 binding sites upstream of luciferase) and Gal4-ELK1. Gal4-ELK1 binds to the Gal4 binding sites and activates transcription when it is phosphorylated by ERK. Luciferase transcription, and thereby the corresponding enzymatic activity in this context is regulated by the level of phosphorylated ELK1, and is used to indirectly monitor and quantify FGF21 activity.

Clone 2E10 was selected as the FGF21 luciferase reporter cell line based on the optimal assay window of 10-20 fold with native FGF21 exhibiting an EC50 in the single nM range.

For the assay, the ELK-luciferase reporter cells were plated in 96 well assay plates, and serum starved overnight. FGF21 or test samples were added for 6 hours at 37 degrees. The plates were then allowed to cool to room temperature and the luciferase activity in the cell lysates was measured with Bright-Glo (Promega).

Example 5.2

ERK-Phosphorylation Assay

Alternative host cell lines specifically L6 (a rat myoblastic cell line) was developed and applied to identify antibodies with FGF21-like signaling activity. The rat L6 cell line is a desirable host cell line for the activity assay because it is known to express minimal levels of endogeneous FGF receptors. The L6 cells do not respond to FGF21 even when transfected with β-Klotho expression vector and therefore provides a cleaner background. (Kurosu et al., (2007) *J. Biol. Chem.* 282, 26687-26695).

L6 cells were maintained in Dulbecco's modified Eagle's medium supplemented with 10% fetal bovine serum and penicillin/streptomycin. Cells were transfected with plasmids expressing βKlotho and individual FGFR using the Lipofectamine 2000 transfection reagent (Invitrogen) according to the manufacturer's protocol.

Analysis of FGF signaling in L6 cells was performed as described in the literature (Kurosu et al., (2007) *J. Biol. Chem.* 282, 26687-26695). Cell cultures were collected 10 min after the treatment of FGF21 or test molecules and snap frozen in liquid nitrogen, homogenized in the lysis buffer and subjected to western blot analysis using an anti-phospho-p44/42 MAP kinase (ERK1/2) antibody and an anti-ERK antibody (Cell Signaling). The percent of phosphorylated ERK versus total ERK protein was determined in this way.

In addition, the factor-dependent mouse BaF3 cell-based proliferation assay used frequently for cytokine receptors can also be developed and applied.

Among the hybridoma supernatants tested in the CHO cell (clone 2E10) based human FGF21 ELK-luciferase reporter assay, over 30 were identified as positive (>5% of the activity of FGF21) when compared to 20 nM FGF21 as the positive control. Antibodies were then purified from the conditioned media of the hybridoma cultures of these positives and tested again in the CHO cell based ELK-luciferase reporter assay. (FIG. 7) showed the representative antibodies in the dose-responsive potency assay with estimated EC50 less than 1 μg/ml (or 6.7 nM). The activities were confirmed in the L6 cell based ERK1/2-phosphrylation assay (FIG. 8) with EC50 less than 10 nM which is consistent to the ELK-luciferase assay in the CHO stable cell line 2E10.

Example 6

Induction of FGF21-Like Signaling is Specific to the FGFR1c/βKlotho Complex

FGF21 has been reported to signal through multiple receptor complexes including FGFR1c, 2c, 3c and 4 when paired with β-Klotho. The selectivity of the FGF21 agonistic antibodies was tested in the rat myoblastic L6 cells transfected with vectors expressing the respective FGFRs and βKlotho. The results shown in FIG. 9 demonstrate that the activity was mediated selectively and exclusively through FGFR1c and not through FGFR2c, 3c or 4 when they were paired with β-Klotho because no activity was detected on the latter receptors up to 100 nM of the agonistic antibodies. This unique selectivity strongly suggests that the action of these antibodies is β-Klotho-dependent yet it must also involve specifically the FGFR1c component of the signaling complex.

Example 7

Activity in Primary Human Adipocytes

FGF21 stimulates glucose uptake and lipolysis in cultured adipocytes, and adipocytes are considered to be more physiologically relevant than the recombinant reporter cell system.

A panel of the antibodies was shown to exhibit Erk-phosphorylation activity similar to FGF21 in the human adipocyte assay (FIG. 10) with estimated EC50 less than 10 nM.

Example 8

Competition Binding and Epitope Binning

To compare the similarity of the binding sites of the antibodies on the FGF21 receptor, a series of competition binding experiments were performed and measured by Biacore™. In one example (and as shown in FIG. 11), two representative agonistic FGF21 receptor antibodies (24H11 and 17D8) and one non-functional FGF21 receptor binding antibodies (1A2.1) were immobilized on the sensor chip surface. Soluble human FGFR1c/β-Klotho ECD-Fc complex or β-Klotho was then captured on the immobilized antibody surfaces. Finally, several of the test FGF21 receptor antibodies were injected individually over the captured soluble human FGF21 receptor or β-Klotho. If the injected antibody recognizes a distinct binding site relative to that recognized by the immobilized antibody, a second binding event will be observed. If the antibodies recognize very similar binding site, no more binding will be observed.

Figure 11A:
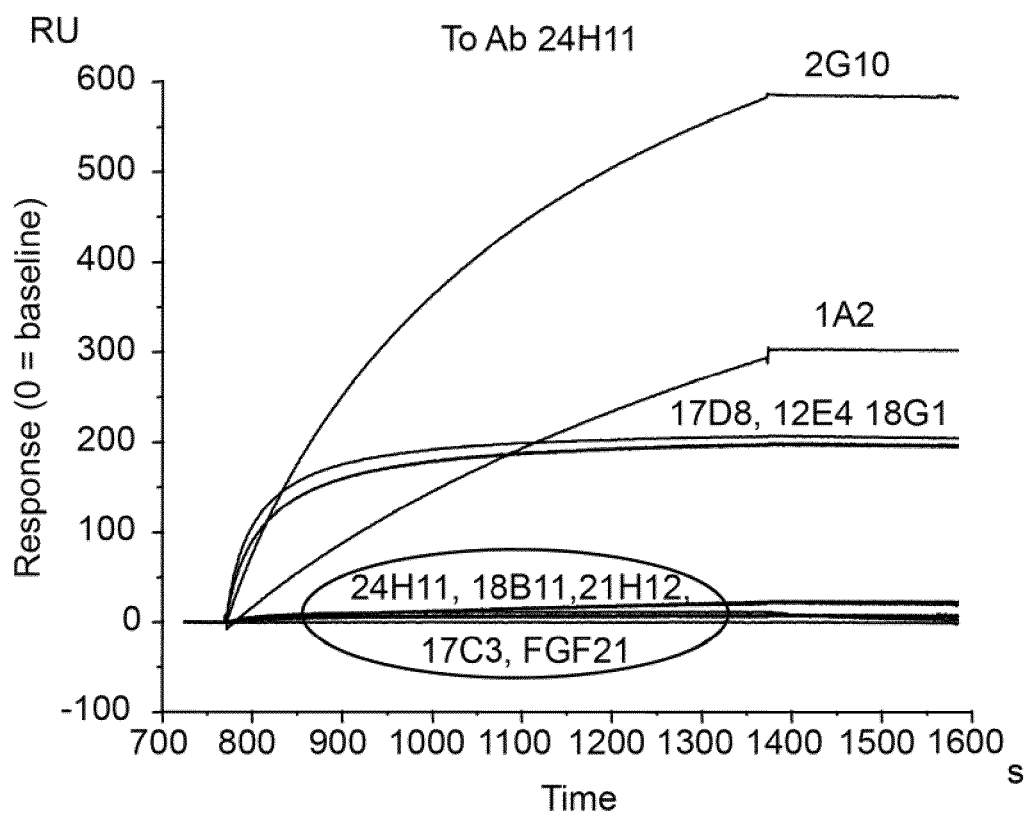
FIGS. 11A-11C are a series of binding sensorgrams (response units vs time) demonstrating that some of the antigen binding proteins that induce FGF21-mediated signaling bind to human β-Klotho at two different but partially overlapping binding sites represented by 24H11 (Group A) and 17D8 (Group B), while antigen binding proteins that do not induce FGF21-mediated signaling (2G10, 1A2) do not bind to these sites.
Figure 11B:
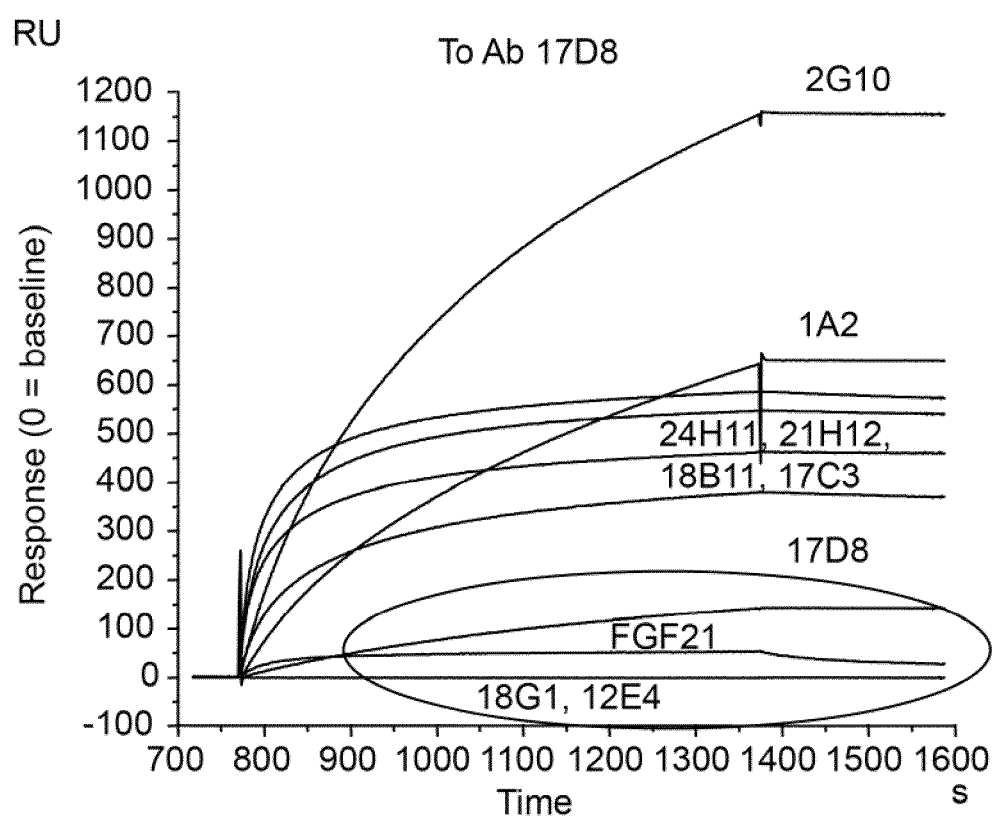

As shown in (FIG. 11A), there are two distinct yet partially overlapping binding sites for the agonistic antibodies tested. One site is covered by 24H11, 21H2, 18B11.1 and 17C3 (Group A) and the other site covered by 17D8, 12E4 and 18G1 (Group B). The two non-functional antibodies 2G10 and 1A2, bind to different sites from each other and are distinct from the two sites covered by the agonistic antibodies in Group A and B. Other functional antibodies binding to Group A epitope included 20D4, 22H5, 16H7, 40D2 and 46D11. Two other functional antibodies 26H11 and 37D3 were shown by this method to bind the same site covered by the Group B antibodies. In addition, a third binding site for functional antibodies was identified for 39F11, 39F7 and 39G5 (group C) which appeared to be distinct from Group A and B binding sites (FIG. 11B).

Another Biacore™ analysis was carried out with biotinylated-FGF21 immobilized on the sensor ship. 10 nM soluble β-Klotho was then passed over the chip alone or mixed with the individual test antibodies at 100nM. (FIG. 12) showed that several agonistic antibodies in group A (24H11, 18B11, 17C3) and antibody 12E4 (from group B) competed significantly with FGF21 in binding to soluble β-Klotho whereas the non-functional antibodies 2G10 and 1A2 and several other functional antibodies did not show competition binding with FGF21.

Figure 11C:
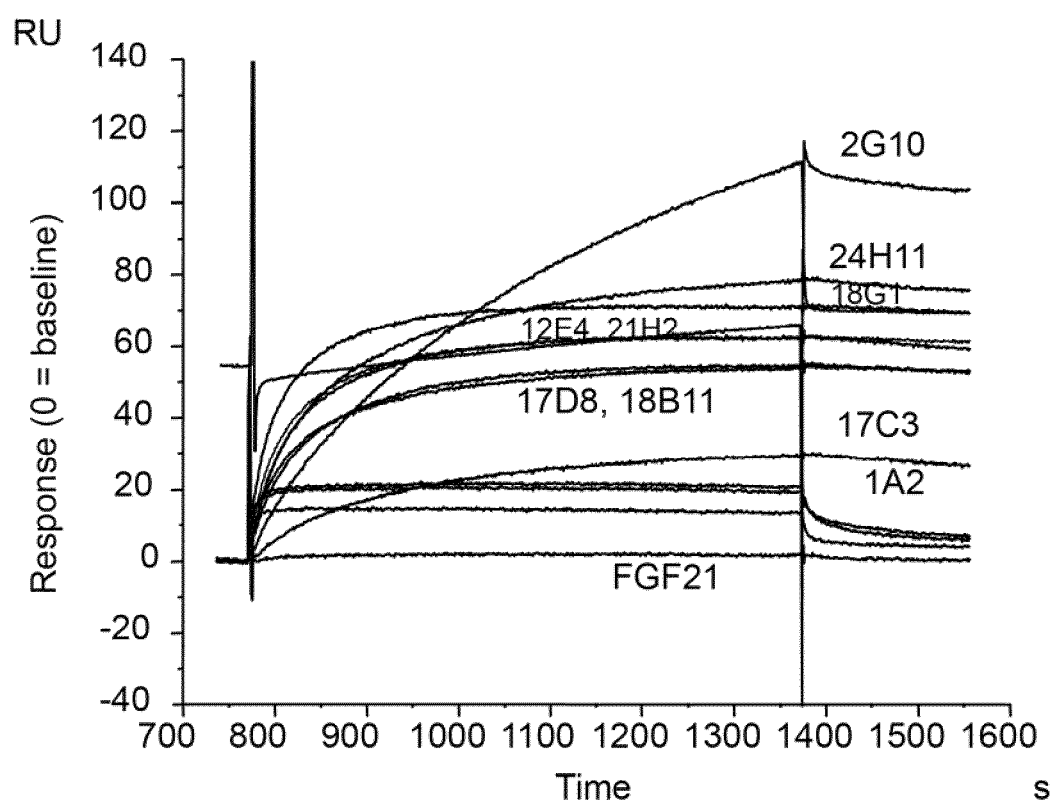
Figure 11E:
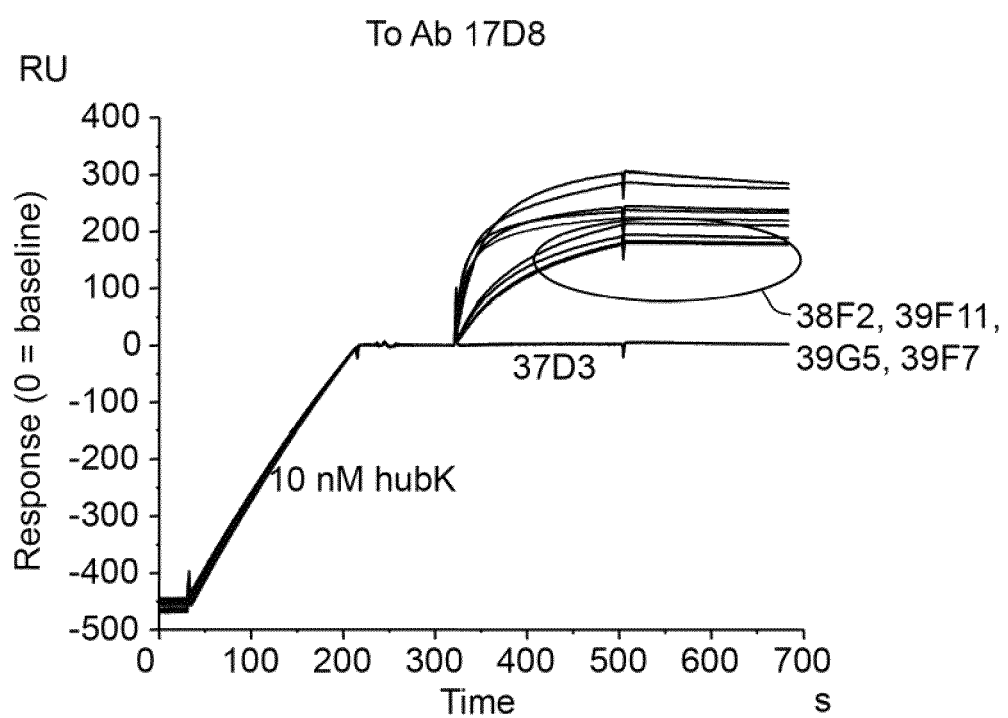
Figure 11F:
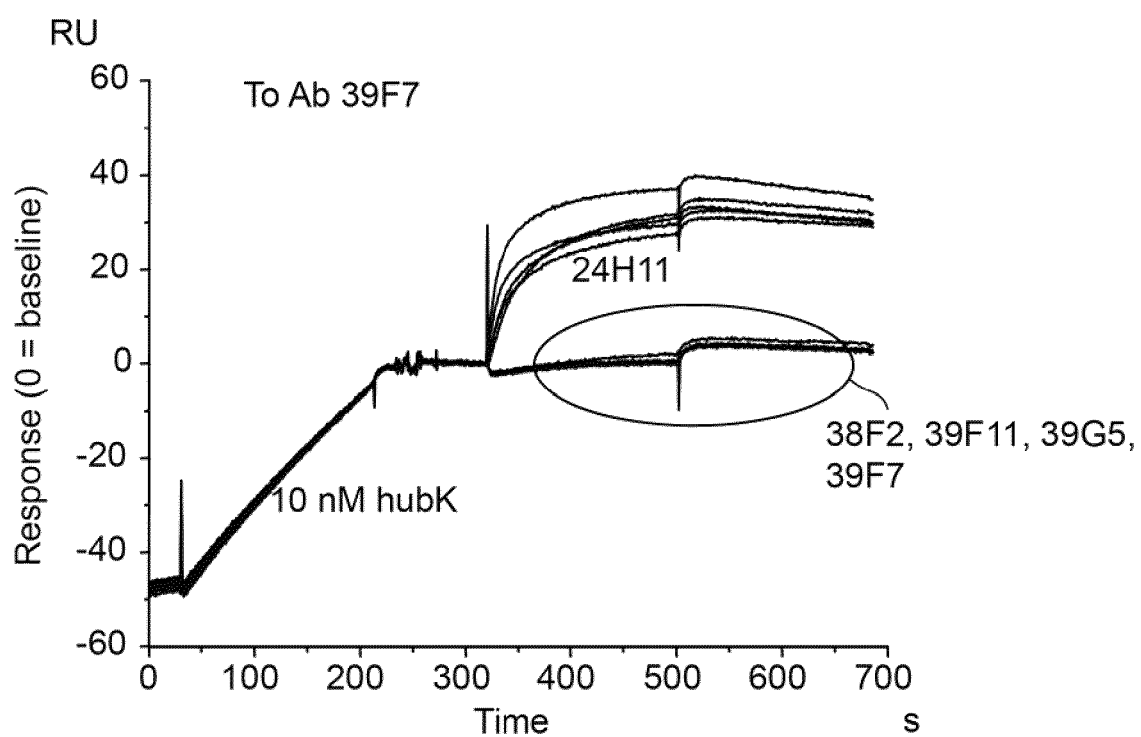

FIG. 11C summarizes the binning results obtained.

Example 9

Recognition of Native and Denatures Structures

The ability of disclosed antigen binding proteins to recognize denatured and native structures was investigated. The procedure and results were as follows.

Example 9.1

FGF21 Receptor Agonistic Antibodies do not Recognize Denatured Structures, as Shown by FACS Cell lysates from CHO cells stably expressing FGF21 receptor (FGFR1c and β-Klotho) or CHO parental cells were diluted with sample buffer without beta-mercaptoethanol (non-reducing conditions). 20 µl of cell lysate was loaded per lane on adjacent lanes separated with a molecular weight marker lane on 4-20% SDS-PAGE gels. Following electrophoresis, the gels were blotted onto 0.2µ nitrocellulose filters. The blots were treated with Tris-buffered saline/Triton-X (TBST) plus 5% non-fat milk (blocking buffer) for 30 minutes. The blots were then cut along the molecular weight marker lanes. The strips were then probed with FGF21 receptor agonistic antibodies (12C3, 26H11, 12E4, 21H2, 18B11, or 20D4), and commercial goat anti-murine βKlotho or mouse anti-huFGFR1 (R&D Diagnostics) in TBST/5% milk. Blots were incubated with the antibodies for one hour at room temperature, followed by three washes with TBST+1% milk. The blots were then probed with anti-human or anti-goat IgG-HRP secondary antibodies for 20 min. Blots were given three 15 min. washes with TBST followed by treatment with Pierce Supersignal West Dura developing reagent (1 min.) and exposure to Kodak Biomax X-ray film.

The commercial anti-β-Klotho and anti-FGFR1 antibodies detected the corresponding receptor proteins in the SDS-PAGE indicating they bind to denatured receptor proteins. In contrast, none of the FGF21 receptor agonistic antibodies tested detected the corresponding protein species suggesting they bind to the native conformational epitope distinct from the commercial antibodies which bind to denatured sequences.

Example 9.2

FGF21 Receptor Agonistic Antibodies Bind to Native Receptor Structure, as Shown by FACS A FACS binding assay was performed with several commercially available FGFR1c and β-Klotho antibodies, and several of the disclosed FGF21 receptor agonistic antibodies. The experiments were performed as follows.

CHO cells stably expressing FGF21 receptor were treated with R&D Systems mouse anti-huFGFR1, goat anti-mu β-Klotho, or FGF21 receptor antibodies 24H11, 17C3, 17D8, 18G1, or 2G10 (1 µg per 1×10$^6$ cells in 100 µl PBS/0.5% BSA). Cells were incubated with the antibodies at 4° C. followed by two washes with PBS/BSA. Cells were then treated with FITC-labeled secondary antibodies at 4° C. followed by two washes. The cells were resuspended in 1 ml PBS/BSA and antibody binding was analyzed using a FACS Calibur instrument.

Consistent with western blot results, all of the FGF21 receptor agonistic antibodies tested bind well to cell surface FGF21 receptor in FACS whereas the commercial anti-β-Klotho or anti-FGFR1 antibodies did not. This observation further confirmed that the FGF21 receptor agonistic antibodies recognize the native structure whereas the commercial antibodies to the receptor components do not.

Example 10

Arginine Scanning

As described above, antigen binding proteins that bind human FGF21R, e.g., FGFR1c, β-Klotho or both FGFR1c and β-Klotho, were created and characterized. To determine the neutralizing determinants on human FGFR1c and/or β-Klotho that these various antigen binding proteins bound, a number of mutant FGFR1c and/or β-Klotho proteins can be constructed having arginine substitutions at select amino acid residues of human FGFR1c and/or β-Klotho. Arginine scanning is an art-recognized method of evaluating where antibodies, or other proteins, bind to another protein, see, e.g., Nanevicz et al., (1995) *J. Biol. Chem.*, 270:37, 21619-21625 and Zupnick et al., (2006) *J. Biol. Chem.*, 281:29, 20464-20473. In general, the arginine sidechain is positively charged and relatively bulky as compared to other amino acids, which can disrupt antibody binding to a region of the antigen where the mutation is introduced. Arginine scanning is a method that determines if a residue is part of a neutralizing determinant and/or an epitope.

Various amino acids distributed throughout the human FGFR1c and/or β-Klotho extracellular domains can be selected for mutation to arginine. The selection can be biased towards charged or polar amino acids to maximize the possibility of the residue being on the surface and reduce the likelihood of the mutation resulting in misfolded protein. Using standard techniques known in the art, sense and anti-sense oligonucleotides containing the mutated residues can be designed based on criteria provided by Stratagene Quickchange® II protocol kit (Stratagene/Agilent, Santa Clara, Calif.). Mutagenesis of the wild-type (WT) FGFR1c and/or β-Klotho sequences can be performed using a Quickchange® II kit (Stratagene). Chimeric constructs can be engineered to encode a FLAG-histidine tag (six histidines (SEQ ID NO: 382)) on the carboxy terminus of the extracellular domain to facilitate purification via the poly-His tag.

Multiplex analysis using the Bio-Plex®Workstation and software (Bio-Rad®, Hercules, Calif.) can be performed to determine neutralizing determinants on human FGFR1c and/or β-Klotho by analyzing exemplary human FGFR1c and/or β-Klotho mAbs differential binding to argininemutants versus wild-type FGFR1c and/or β-Klotho proteins. Any number of bead codes of pentaHis-coated beads ("penta-His" disclosed as SEQ ID NO: 383) (Qiagen®, Valencia, Calif.) can be used to capture histidine-tagged protein. The bead codes can allow the multiplexing of FGFR1c and/or β-Klotho arginine mutants and wild-type human FGFR1c and/or β-Klotho.

To prepare the beads, 100 ul of wild-type FGFR1c and/or β-Klotho and FGFR1c and/or β-Klotho arginine mutant supernatants from transient expression culture are bound to penta-His-coated beads ("penta-His" disclosed as SEQ ID NO: 383) overnight at 4° C. or 2 hours at room temperature with vigorous shaking. The beads are then washed as per the manufacturer's protocol and the bead set pooled and aliquoted into 2 or 3 columns of a 96-well filter plate (Millipore, Bellerica, Mass., product #MSBVN1250) for duplicate or triplicate assay points, respectively. 100 µl anti-FGFR1c and/or anti-β-Klotho antibodies in 4-fold dilutions are added to the wells, incubated for 1 hour at room temperature, and washed. 100 µl of a 1:100 dilution of PE-conjugated anti-human IgG Fc (Jackson Labs., Bar Harbor, Me., product #109-116-170) is added to each well, incubated for 1 hour at room temperature and washed. Beads are resuspended in 1% BSA, shaken for 3 minutes, and read on the Bio-Plex workstation. Antibody binding to FGFR1c and/or β-Klotho arginine mutant protein is compared to antibody binding to the human FGFR1c and/or β-Klotho wild-type from the same pool. A titration of antibody over approximately a 5 log scale can be performed. Median Fluorescence Intensity (MFI) of FGFR1c and/or β-Klotho arginine mutant proteins can be graphed as a percent of maximum wild-type human FGFR1c and/or β-Klotho signal. Those mutants for which signal from all the antibodies are below a cut-off value, e.g., 30% of wild-type FGFR1c and/or β-Klotho can be deemed to be either of too low a protein concentration on the bead due to poor expression in the transient culture or possibly misfolded and can be excluded from analysis. Mutations (i.e., arginine substitutions) that increase the EC50 for the FGFR1c and/or β-Klotho mAb by a cut-off value, e.g., 3-fold or greater (as calculated by, e.g., GraphPad Prism®) can be considered to have negatively affected FGFR1c and/or β-Klotho mAb binding. Through these methods, neutralizing determinants and epitopes for various FGFR1c and/or β-Klotho antibodies are elucidated.

Example 11

Construction of Chimeric Receptors

In another method of determining the activation determinants on human FGFR1c and/or β-Klotho that these various antigen binding proteins bind, specific chimeric FGFR1c and/or β-Klotho proteins between human and mouse species can be constructed, expressed in transient or stable 293 or CHO cells as described before and tested. For example, a chimeric FGF21 receptor can be constructed comprising native human FGFR1c, FGFR2c, FGFR3c or FGFR4, in one example FGFR1c, paired with chimeric human/mouse β-Klotho in which selected regions or sequences on the human β-Klotho are systematically replaced by the corresponding mouse-specific residues (see, e.g., FIG. 2A-2C). Similarly, native human β-Klotho paired with chimeric human/mouse FGFR1c, FGFR2c, FGFR3c or FGFR4, in one example FGFR1c in which selected regions or sequences on the human FGFR1c are systematically replaced by the corresponding mouse-specific residues (see, e.g., the alignments of FIGS. 1A-1B). The critical sequences involved in the binding and/or activity of the antigen binding proteins can be derived through binding assay or activity measurements described in previous Examples 4, 5, 6 and 7 based on the chimeric FGF21 receptors.

Example 11.1

Construction of Specific Chimeras

Figure 29:
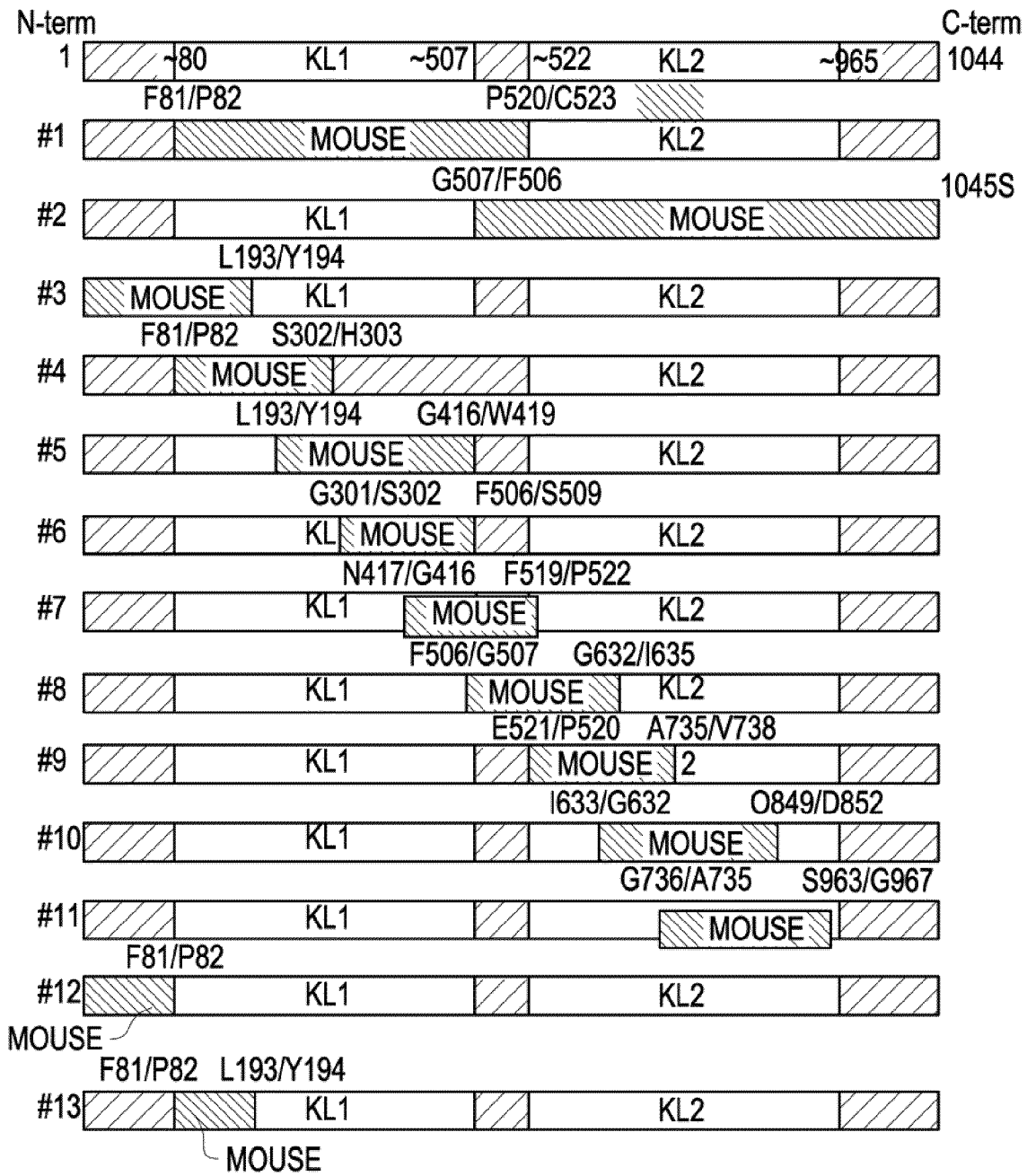
FIG. 29 is a schematic depicting human-mouse β-Klotho chimeras that were constructed and used to studying the binding of antigen binding proteins.

Human-mouse β-Klotho chimeras were constructed using the methodology described in Example 14. A schematic of the chimeras constructed is presented in FIG. 29; summarily, the chimeras generated comprised (from N to C terminus) a fusion of a human β-Klotho sequence fused to a murine β-Klotho sequence fused to a human β-Klotho sequence. Human β-Klotho (SEQ ID NO:8) was used as a framework into which regions of murine β-Klotho (full length sequence shown in SEQ ID NO:468) were inserted. The regions of murine β-Klotho that were inserted were as follows:

```
Murine Residues 82P-520P
                                                      (SEQ ID NO: 470)
PKNFSWGVGTGAFQVEGSWKTDGRGPSIWDRYVYSHLRGVNGTDRSTDSYIFLEKDLL

ALDFLGVSFYQFSISWPRLFPNGTVAAVNAQGLRYYRALLDSLVLRNIEPIVTLYHWDLP

LTLQEEYGGWKNATMIDLFNDYATYCFQTFGDRVKYWITIHNPYLVAWHGFGTGMHA

PGEKGNLTAVYTVGHNLIKAHSKVWHNYDKNFRPHQKGWLSITLGSHWIEPNRTDNM

EDVINCQHSMSSVLGWFANPIHGDGDYPEFMKTGAMIPEFSEAEKEEVRGTADFFAFSF

GPNNFRPSNTVVKMGQNVSLNLRQVLNWIKLEYDDPQILISENGWFTDSYIKTEDTTAIY

MMKNFLNQVLQAIKFDEIRVFGYTAWTLLDGFEWQDAYTTRRGLFYVDFNSEQKERKP

KSSAHYYKQIIQDNGFPLKESTPDMKGRFP

Murine Residues 506F-1043S
                                                      (SEQ ID NO: 471)
FPLKESTPDMKGRFPCDFSWGVTESVLKPEFTVSSPQFTDPHLYVWNVTGNRLLYRVEG

VRLKTRPSQCTDYVSIKKRVEMLAKMKVTHYQFALDWTSILPTGNLSKVNRQVLRYYR

CVVSEGLKLGVFPMVTLYHPTHSHLGLPLPLLSSGGWLNMNTAKAFQDYAELCFRELG

DLVKLWITINEPNRLSDMYNRTSNDTYRAAHNLMIAHAQVWHLYDRQYRPVQHGAVS

LSLHCDWAEPANPFVDSHWKAAERFLQFEIAWFADPLFKTGDYPSVMKEYIASKNQRG

LSSSVLPRFTAKESRLVKGTVDFYALNHFTTRFVIHKQLNTNRSVADRDVQFLQDITRLS

SPSRLAVTPWGVRKLLAWIRRNYRDRDIYITANGIDDLALEDDQIRKYYLEKYVQEALK

AYLIDKVKIKGYYAFKLTEEKSKPRFGFFTSDFRAKSSVQFYSKLISSSGLPAENRSPACG

QPAEDTDCTICSFLVEKKPLIFFGCCFISTLAVLLSITVFHHQKRRKFQKARNLQNIPLKK

GHSRVFS
```

Murine Residues 1M-193L
(SEQ ID NO: 472)
MKTGCAAGSPGNEWIFFSSDERNTRSRKTMSNRALQRSAVLSAFVLLRAVTGFSGDGK

AIWDKKQYVSPVNPSQLFLYDTFPKNFSWGVGTGAFQVEGSWKTDGRGPSIWDRYVYS

HLRGVNGTDRSTDSYIFLEKDLLALDFLGVSFYQFSISWPRLFPNGTVAAVNAQGLRYY

RALLDSLVLRNIEPIVTL

Murine Residues 82P-302S
(SEQ ID NO: 473)
PKNFSWGVGTGAFQVEGSWKTDGRGPSIWDRYVYSHLRGVNGTDRSTDSYIFLEKDLL

ALDFLGVSFYQFSISWPRLFPNGTVAAVNAQGLRYYRALLDSLVLRNIEPIVTLYHWDLP

LTLQEEYGGWKNATMIDLFNDYATYCFQTFGDRVKYWITIHNPYLVAWHGFGTGMHA

PGEKGNLTAVYTVGHNLIKAHSKVWHNYDKNFRPHQKGWLSITLGS

Murine Residues 194Y-416G
(SEQ ID NO: 474)
YHWDLPLTLQEEYGGWKNATMIDLFNDYATYCFQTFGDRVKYWITIHNPYLVAWHGF

GTGMHAPGEKGNLTAVYTVGHNLIKAHSKVWHNYDKNFRPHQKGWLSITLGSHWIEP

NRTDNMEDVINCQHSMSSVLGWFANPIHGDGDYPEFMKTGAMIPEFSEAEKEEVRGTA

DFFAFSFGPNNFRPSNTVVKMGQNVSLNLRQVLNWIKLEYDDPQILISENG

Murine Residues 302S-506F
(SEQ ID NO: 475)
SHWIEPNRTDNMEDVINCQHSMSSVLGWFANPIHGDGDYPEFMKTGAMIPEFSEAEKEE

VRGTADFFAFSFGPNNFRPSNTVVKMGQNVSLNLRQVLNWIKLEYDDPQILISENGWFT

DSYIKTEDTTAIYMMKNFLNQVLQAIKFDEIRVFGYTAWTLLDGFEWQDAYTTRRGLFY

VDFNSEQKERKPKSSAHYYKQIIQDNGF

Murine Residues 416G-519P
(SEQ ID NO: 476)
GWFTDSYIKTEDTTAIYMMKNFLNQVLQAIKFDEIRVFGYTAWTLLDGFEWQDAYTTR

RGLFYVDFNSEQKERKPKSSAHYYKQIIQDNGFPLKESTPDMKGRF

Murine Residues 507P-632G
(SEQ ID NO: 477)
PLKESTPDMKGRFPCDFSWGVTESVLKPEFTVSSPQFTDPHLYVWNVTGNRLLYRVEGV

RLKTRPSQCTDYVSIKKRVEMLAKMKVTHYQFALDWTSILPTGNLSKVNRQVLRYYRC

VVSEGLKLG

Murine Residues 520P-735A
(SEQ ID NO: 478)
PCDFSWGVTESVLKPEFTVSSPQFTDPHLYVWNVTGNRLLYRVEGVRLKTRPSQCTDY

VSIKKRVEMLAKMKVTHYQFALDWTSILPTGNLSKVNRQVLRYYRCVVSEGLKLGVFP

MVTLYHPTHSHLGLPLPLLSSGGWLNMNTAKAFQDYAELCFRELGDLVKLWITINEPNR

LSDMYNRTSNDTYRAAHNLMIAHAQVWHLYDRQYRPVQHGA

Murine Residues 632G-849Q
(SEQ ID NO: 479)
GVFPMVTLYHPTHSHLGLPLPLLSSGGWLNMNTAKAFQDYAELCFRELGDLVKLWITIN

EPNRLSDMYNRTSNDTYRAAHNLMIAHAQVWHLYDRQYRPVQHGAVSLSLHCDWAE

PANPFVDSHWKAAERFLQFEIAWFADPLFKTGDYPSVMKEYIASKNQRGLSSSVLPRFT

AKESRLVKGTVDFYALNHFTTRFVIHKQLNTNRSVADRDVQFLQ

Murine Residues 735A-963S
(SEQ ID NO: 480)
AVSLSLHCDWAEPANPFVDSHWKAAERFLQFEIAWFADPLFKTGDYPSVMKEYIASKN

QRGLSSSVLPRFTAKESRLVKGTVDFYALNHFTTRFVIHKQLNTNRSVADRDVQFLQDIT

-continued

```
RLSSPSRLAVTPWGVRKLLAWIRRNYRDRDIYITANGIDDLALEDDQIRKYYLEKYVQE

ALKAYLIDKVKIKGYYAFKLTEEKSKPRFGFFTSDFRAKSSVQFYSKLISSS

Murine Residues 1M-81F
                                                 (SEQ ID NO: 481)
MKTGCAAGSPGNEWIFFSSDERNTRSRKTMSNRALQRSAVLSAFVLLRAVTGFSGDGK

AIWDKKQYVSPVNPSQLFLYDTF

Murine Residues 82P-193L
                                                 (SEQ ID NO: 482)
PKNFSWGVGTGAFQVEGSWKTDGRGPSIWDRYVYSHLRGVNGTDRSTDSYIFLEKDLL

ALDFLGVSFYQFSISWPRLFPNGTVAAVNAQGLRYYRALLDSLVLRNIEPIVTL
```

The chimeras generated using the murine β-Klotho sequences comprised the following components:

| Construct Identifier | Construct SEQ ID NO | N-terminal Human β-Klotho Residues | Mouse β-Klotho Residues | C-terminal Human β-Klotho Residues |
|---|---|---|---|---|
| huBeta_Klotho(1-81, 523-1044) (muBetaKLOTHO 82-520) | | 1-81 | 82-520 | 523-1044 |
| huBeta_Klotho(1-507) (muBetaKLOTHO 506F-1045S) | | 1-507 | 506-1043 | |
| huBeta_Klotho(194-1044) (muBetaKLOTHO 1-L193) | | | 1-193 | 194-1044 |
| huBeta_Klotho(1-81, 303-1044) (muBetaKLOTHO 82P-302S) | | 1-81 | 82-302 | 303-1044 |
| huBeta_Klotho(1-193, 419-1044) (muBetaKLOTHO Y194-416G) | | 1-193 | 194-416 | 419-1044 |
| huBeta_Klotho(1-301, 509-1044) (muBetaKLOTHO S302-F506) | | 1-301 | 302-506 | 509-1044 |
| huBeta_Klotho(1-417, 522-1044) (muBetaKLOTHO G416-F519) | | 1-417 | 416-519 | 522-1044 |
| huBeta_Klotho(1-507, 635-1044) (muBeta KLOTHO F06-G632) | | 1-508 | 507-632 | 635-1044 |
| huBeta_Klotho(1-521, 738-1044) (muBeta KLOTHO 520P-735A) | | 1-521 | 520-735 | 738-1044 |
| huBeta_Klotho(1-633, 852-1044) (muBeta KLOTHO 632G-849Q) | | 1-633 | 632-849 | 852-1044 |
| huBeta_Klotho(1-736, 967-1044) (muBeta KLOTHO 735A-963S) | | 1-736 | 735-963 | 967-1044 |
| huBeta_Klotho(82-1044)(muBeta KLOTHO 1-81F) | | | 1-81 | 82-1044 |
| huBeta_Klotho(1-81, 194-1044) (muBeta KLOTHO 82P-193L) | | 1-81 | 82-193 | 194-1044 |

The generated chimeras comprised the following amino acid sequences:

```
(i)     huBeta_Klotho(1-81, 523-1044)(muBetaKLOTHO 82-520)
                                                 (SEQ ID NO: 455)
        MKPGCAAGSPGNEWIFFSTDEITTRYRNTMSNGGLQRSVILSALILLRAV
        TGFSGDGRAIWSKNPNFTPVNESQLFLYDTFPKNFSWGVGTGAFQVEGSW
        KTDGRGPSIWDRYVYSHLRGVNGTDRSTDSYIFLEKDLLALDFLGVSFYQ
        FSISWPRLFPNGTVAAVNAQGLRYYRALLDSLVLRNIEPIVTLYHWDLPL
        TLQEEYGGWKNATMIDLFNDYATYCFQTFGDRVKYWITIHNPYLVAWHGF
        GTGMHAPGEKGNLTAVYTVGHNLIKAHSKVWHNYDKNFRPHQKGWLSITL
        GSHWIEPNRTDNMEDVINCQHSMSSVLGWFANPIHGDGDYPEFMKTGAMI
        PEFSEAEKEEVRGTADFFAFSFGPNNFRPSNTVVKMGQNVSLNLRQVLNW
        IKLEYDDPQILISENGWFTDSYIKTEDTTAIYMMKNFLNQVLQAIKFDEI
        RVFGYTAWTLLDGFEWQDAYTTRRGLFYVDFNSEQKERKPKSSAHYYKQI
        IQDNGFPLKESTPDMKGRFPCDFSWGVTESVLKPESVASSPQFSDPHLYV
        WNATGNRLLHRVEGVRLKTRPAQCTDFVNIKKQLEMLARMKVTHYRFALD
        WASVLPTGNLSAVNRQALRYYRCVVSEGLKLGISAMVTLYYPTHAHLGLP
        EPLLHADGWLNPSTAEAFQAYAGLCFQELGDLVKLWITINEPNRLSDIYN
        RSGNDTYGAAHNLLVAHALAWRLYDQQFRPSQRGAVSLSLHADWAEPANP
        YADSHWRAAERFLQFEIAWFAEPLFKTGDYPAAMREYIASKHRRGLSSSA
        LPRLTEAERRLLKGTVDFCALNHFTTRFVMHEQLAGSRYDSDRDIQFLQD
        ITRLSSPTRLAVIPWGVRKLLRWVRRNYGDMDIYITASGIDDQALEDDRL
        RKYYLGKYLQEVLKAYLIDKVRIKGYYAFKLAEEKSKPRFGFFTSDFKAK
```

-continued
SSIQFYNKVISSRGFPFENSSSRCSQTQENTECTVCLFLVQKKPLIFLGC
CFFSTLVLLLSIAIFQRQKRRKFWKAKNLQHIPLKKGKRVVS (ii) huBeta_Klotho(1-507)(muBetaKLOTHO 506F-1045S)
(SEQ ID NO: 456)
MKPGCAAGSPGNEWIFFSTDEITTRYRNTMSNGGLQRSVILSALILLRAV
TGFSGDGRAIWSKNPNFTPVNESQLFLYDTFPKNFFWGIGTGALQVEGSW
KKDGKGPSIWDHFIHTHLKNVSSTNGSSDSYIFLEKDLSALDFIGVSFYQ
FSISWPRLFPDGIVTVANAKGLQYYSTLLDALVLRNIEPIVTLYHWDLPL
ALQEKYGGWKNDTIIDIFNDYATYCFQMFGDRVKYWITIHNPYLVAWHGY
GTGMHAPGEKGNLAAVYTVGHNLIKAHSKVWHNYNTHFRPHQKGWLSITL
GSHWIEPNRSENTMDIFKCQQSMVSVLGWFANPIHGDGDYPEGMRKKLFS
VLPIFSEAEKHEMRGTADFFAFSFGPNNFKPLNTMAKMGQNVSLNLREAL
NWIKLEYNNPRILIAENGWFTDSRVKTEDTTAIYMMKNFLSQVLQAIRLD
EIRVFGYTAWSLLDGFEWQDAYTIRRGLFYVDFNSKQKERKPKSSAHYYK
QIIRENGFPLKESTPDMKGRFPCDFSWGVTESVLKPEFTVSSPQFTDPHL
YVWNVTGNRLLYRVEGVRLKTRPSQCTDYVSIKKRVEMLAKMKVTHYQFA
LDWTSILPTGNLSKVNRQVLRYYRCVVSEGLKLGVFPMVTLYHPTHSHLG
LPLPLLSSGGWLNMNTAKAFQDYAELCFRELGDLVKLWITINEPNRLSDM
YNRTSNDTYRAAHNLMIAHAQVWHLYDRQYRPVQHGAVSLSLHCDWAEPA
NPFVDSHWKAAERFLQFEIAWFADPLFKTGDYPSVMKEYIASKNQRGLSS
SVLPRFTAKESRLVKGTVDFYALNHFTTRFVIHKQLNTNRSVADRDVQFL
QDITRLSSPSRLAVTPWGVRKLLAWIRRNYRDRDIYITANGIDDLALEDD
QIRKYYLEKYVQEALKAYLIDKVKIKGYYAFKLTEEKSKPRFGFFTSDFR
AKSSVQFYSKLISSSGLPAENRSPACGQPAEDTDCTICSFLVEKKPLIFF
GCCFISTLAVLLSITVFHHQKRRKFQKARNLQNIPLKKGHSRVFS (iii) huBeta_Klotho(194-1044)(muBetaKLOTHO 1-L193)
(SEQ ID NO: 457)
MKTGCAAGSPGNEWIFFSSDERNTRSRKTMSNRALQRSAVLSAFVLLRAV
TGFSGDGKAIWDKKQYVSPVNPSQLFLYDTFPKNFSWGVGTGAFQVEGSW
KTDGRGPSIWDRYVYSHLRGVNGTDRSTDSYIFLEKDLLALDFLGVSFYQ
FSISWPRLFPNGTVAAVNAQGLRYYRALLDSLVLRNIEPIVTLYHWDLPL
ALQEKYGGWKNDTIIDIFNDYATYCFQMFGDRVKYWITIHNPYLVAWHGY
GTGMHAPGEKGNLAAVYTVGHNLIKAHSKVWHNYNTHFRPHQKGWLSITL
GSHWIEPNRSENTMDIFKCQQSMVSVLGWFANPIHGDGDYPEGMRKKLFS
VLPIFSEAEKHEMRGTADFFAFSFGPNNFKPLNTMAKMGQNVSLNLREAL
NWIKLEYNNPRILIAENGWFTDSRVKTEDTTAIYMMKNFLSQVLQAIRLD
EIRVFGYTAWSLLDGFEWQDAYTIRRGLFYVDFNSKQKERKPKSSAHYYK
QIIRENGFSLKESTPDVQGQFPCDFSWGVTESVLKPESVASSPQFSDPHL
YVWNATGNRLLHRVEGVRLKTRPAQCTDFVNIKKQLEMLARMKVTHYRFA
LDWASVLPTGNLSAVNRQALRYYRCVVSEGLKLGISAMVTLYYPTHAHLG
LPEPLLHADGWLNPSTAEAFQAYAGLCFQELGDLVKLWITINEPNRLSDI
YNRSGNDTYGAAHNLLVAHALAWRLYDQQFRPSQRGAVSLSLHADWAEPA
NPYADSHWRAAERFLQFEIAWFAEPLFKTGDYPAAMREYIASKHRRGLSS
SALPRLTEAERRLLKGTVDFCALNHFTTRFVMHEQLAGSRYDSDRDIQFL
QDITRLSSPTRLAVIPWGVRKLLRWVRRNYGDMDIYITASGIDDQALEDD
RLRKYYLGKYLQEVLKAYLIDKVRIKGYYAFKLAEEKSKPRFGFFTSDFK
AKSSIQFYNKVISSRGFPPENSSSRCSQTQENTECTVCLFLVQKKPLIFL
GCCFFSTLVLLLSIAIFQRQKRRKFWKAKNLQHIPLKKGKRVVS (iv) huBeta_Klotho(1-81, 303-1044)(muBetaKLOTHO 82P-302S)
(SEQ ID NO: 458)
MKPGCAAGSPGNEWIFFSTDEITTRYRNTMSNGGLQRSVILSALILLRAV
TGFSGDGRAIWSKNPNFTPVNESQLFLYDTFPKNFSWGVGTGAFQVEGSW
KTDGRGPSIWDRYVYSHLRGVNGTDRSTDSYIFLEKDLLALDFLGVSFYQ
FSISWPRLFPNGTVAAVNAQGLRYYRALLDSLVLRNIEPIVTLYHWDLPL
TLQEEYGGWKNATMIDLFNDYATYCFQTFGDRVKYWITIHNPYLVAWHGF
GTGMHAPGEKGNLTAVYTVGHNLIKAHSKVWHNYDKNFRPHQKGWLSITL
GSHWIEPNRSENTMDIFKCQQSMVSVLGWFANPIHGDGDYPEGMRKKLFS
VLPIFSEAEKHEMRGTADFFAFSFGPNNFKPLNTMAKMGQNVSLNLREAL
NWIKLEYNNPRILIAENGWFTDSRVKTEDTTAIYMMKNFLSQVLQAIRLD
EIRVFGYTAWSLLDGFEWQDAYTIRRGLFYVDFNSKQKERKPKSSAHYYK
QIIRENGFSLKESTPDVQGQFPCDFSWGVTESVLKPESVASSPQFSDPHL
YVWNATGNRLLHRVEGVRLKTRPAQCTDFVNIKKQLEMLARMKVTHYRFA
LDWASVLPTGNLSAVNRQALRYYRCVVSEGLKLGISAMVTLYYPTHAHLG
LPEPLLHADGWLNPSTAEAFQAYAGLCFQELGDLVKLWITINEPNRLSDI
YNRSGNDTYGAAHNLLVAHALAWRLYDQQFRPSQRGAVSLSLHADWAEPA
NPYADSHWRAAERFLQFEIAWFAEPLFKTGDYPAAMREYIASKHRRGLSS
SALPRLTEAERRLLKGTVDFCALNHFTTRFVMHEQLAGSRYDSDRDIQFL
QDITRLSSPTRLAVIPWGVRKLLRWVRRNYGDMDIYITASGIDDQALEDD
RLRKYYLGKYLQEVLKAYLIDKVRIKGYYAFKLAEEKSKPRFGFFTSDFK
AKSSIQFYNKVISSRGFPPENSSSRCSQTQENTECTVCLFLVQKKPLIFL
GCCFFSTLVLLLSIAIFQRQKRRKFWKAKNLQHIPLKKGKRVVS (v) huBeta_Klotho(1-193, 419-1044)(muBetaKLOTHO Y194-416G)
(SEQ ID NO: 459)
MKPGCAAGSPGNEWIFFSTDEITTRYRNTMSNGGLQRSVILSALILLRAV
TGFSGDGRAIWSKNPNFTPVNESQLFLYDTFPKNFFWGIGTGALQVEGSW
KKDGKGPSIWDHFIHTHLKNVSSTNGSSDSYIFLEKDLSALDFIGVSFYQ
FSISWPRLFPDGIVTVANAKGLQYYSTLLDALVLRNIEPIVTLYHWDLPL

```
TLQEEYGGWKNATMIDLFNDYATYCFQTFGDRVKYWITIHNPYLVAWHGF
GTGMHAPGEKGNLTAVYTVGHNLIKAHSKVWHNYDKNFRPHQKGWLSITL
GSHWIEPNRTDNMEDVINCQHSMSSVLGWFANPIHGDGDYPEFMKTGAMI
PEFSEAEKEEVRGTADFFAFSFGPNNFRPSNTVVKMGQNVSLNLRQVLNW
IKLEYDDPQILISENGWFTDSRVKTEDTTAIYMMKNFLSQVLQAIRLDEI
RVFGYTAWSLLDGFEWQDAYTIRRGLFYVDFNSKQKERKPKSSAHYYKQI
IRENGFSLKESTPDVQGQFPCDFSWGVTESVLKPESVASSPQFSDPHLYV
WNATGNRLLHRVEGVRLKTRPAQCTDFVNIKKQLEMLARMKVTHYRFALD
WASVLPTGNLSAVNRQALRYYRCVVSEGLKLGISAMVTLYYPTHAHLGLP
EPLLHADGWLNPSTAEAFQAYAGLCFQELGDLVKLWITINEPNRLSDIYN
RSGNDTYGAAHNLLVAHALAWRLYDQQFRPSQRGAVSLSLHADWAEPANP
YADSHWRAAERFLQFEIAWFAEPLFKTGDYPAAMREYIASKHRRGLSSSA
LPRLTEAERRLLKGTVDFCALNHFTTRFVMHEQLAGSRYDSDRDIQFLQD
ITRLSSPTRLAVIPWGVRKLLRWVRRNYGDMDIYITASGIDDQALEDDRL
RKYYLGKYLQEVLKAYLIDKVRIKGYYAFKLAEEKSKPRFGFFTSDFKAK
SSIQFYNKVISSRGFPFENSSSRCSQTQENTECTVCLFLVQKKPLIFLGC
CFFSTLVLLLSIAIFQRQKRRKFWKAKNLQHIPLKKGKRVVS
```

(vi) huBeta_Klotho(1-301, 509-1044)(muBetaKLOTHO S302-F506)
(SEQ ID NO: 460)

```
MKPGCAAGSPGNEWIFFSTDEITTRYRNTMSNGGLQRSVILSALILLRAV
TGFSGDGRAIWSKNPNFTPVNESQLFLYDTFPKNFFWGIGTGALQVEGSW
KKDGKGPSIWDHFIHTHLKNVSSTNGSSDSYIFLEKDLSALDFIGVSFYQ
FSISWPRLFPDGIVTVANAKGLQYYSTLLDALVLRNIEPIVTLYHWDLPL
ALQEKYGGWKNDTIIDIFNDYATYCFQMFGDRVKYWITIHNPYLVAWHGY
GTGMHAPGEKGNLAAVYTVGHNLIKAHSKVWHNYNTHFRPHQKGWLSITL
GSHWIEPNRTDNMEDVINCQHSMSSVLGWFANPIHGDGDYPEFMKTGAMI
PEFSEAEKEEVRGTADFFAFSFGPNNFRPSNTVVKMGQNVSLNLRQVLNW
IKLEYDDPQILISENGWFTDSYIKTEDTTAIYMMKNFLNQVLQAIKFDEI
RVFGYTAWTLLDGFEWQDAYTTRRGLFYVDFNSEQKERKPKSSAHYYKQI
IQDNGFSLKESTPDVQGQFPCDFSWGVTESVLKPESVASSPQFSDPHLYV
WNATGNRLLHRVEGVRLKTRPAQCTDFVNIKKQLEMLARMKVTHYRFALD
WASVLPTGNLSAVNRQALRYYRCVVSEGLKLGISAMVTLYYPTHAHLGLP
EPLLHADGWLNPSTAEAFQAYAGLCFQELGDLVKLWITINEPNRLSDIYN
RSGNDTYGAAHNLLVAHALAWRLYDQQFRPSQRGAVSLSLHADWAEPANP
YADSHWRAAERFLQFEIAWFAEPLFKTGDYPAAMREYIASKHRRGLSSSA
LPRLTEAERRLLKGTVDFCALNHFTTRFVMHEQLAGSRYDSDRDIQFLQD
ITRLSSPTRLAVIPWGVRKLLRWVRRNYGDMDIYITASGIDDQALEDDRL
RKYYLGKYLQEVLKAYLIDKVRIKGYYAFKLAEEKSKPRFGFFTSDFKAK
SSIQFYNKVISSRGFPFENSSSRCSQTQENTECTVCLFLVQKKPLIFLGC
CFFSTLVLLLSIAIFQRQKRRKFWKAKNLQHIPLKKGKRVVS
```

(vii) huBeta_Klotho(1-417, 522-1044)(muBetaKLOTHO G416-F519)
(SEQ ID NO: 461)

```
MKPGCAAGSPGNEWIFFSTDEITTRYRNTMSNGGLQRSVILSALILLRAV
TGFSGDGRAIWSKNPNFTPVNESQLFLYDTFPKNFFWGIGTGALQVEGSW
KKDGKGPSIWDHFIHTHLKNVSSTNGSSDSYIFLEKDLSALDFIGVSFYQ
FSISWPRLFPDGIVTVANAKGLQYYSTLLDALVLRNIEPIVTLYHWDLPL
ALQEKYGGWKNDTIIDIFNDYATYCFQMFGDRVKYWITIHNPYLVAWHGY
GTGMHAPGEKGNLAAVYTVGHNLIKAHSKVWHNYNTHFRPHQKGWLSITL
GSHWIEPNRSENTMDIFKCQQSMVSVLGWFANPIHGDGDYPEGMRKKLFS
VLPIFSEAEKHEMRGTADFFAFSFGPNNFKPLNTMAKMGQNVSLNLREAL
NWIKLEYNNPRILIAENGWFTDSYIKTEDTTAIYMMKNFLNQVLQAIKFD
EIRVFGYTAWTLLDGFEWQDAYTTRRGLFYVDFNSEQKERKPKSSAHYYK
QIIQDNGFPLKESTPDMKGRFPCDFSWGVTESVLKPESVASSPQFSDPHL
YVWNATGNRLLHRVEGVRLKTRPAQCTDFVNIKKQLEMLARMKVTHYRFA
LDWASVLPTGNLSAVNRQALRYYRCVVSEGLKLGISAMVTLYYPTHAHLG
LPEPLLHADGWLNPSTAEAFQAYAGLCFQELGDLVKLWITINEPNRLSDI
YNRSGNDTYGAAHNLLVAHALAWRLYDQQFRPSQRGAVSLSLHADWAEPA
NPYADSHWRAAERFLQFEIAWFAEPLFKTGDYPAAMREYIASKHRRGLSS
SALPRLTEAERRLLKGTVDFCALNHFTTRFVMHEQLAGSRYDSDRDIQFL
QDITRLSSPTRLAVIPWGVRKLLRWVRRNYGDMDIYITASGIDDQALEDD
RLRKYYLGKYLQEVLKAYLIDKVRIKGYYAFKLAEEKSKPRFGFFTSDFK
AKSSIQFYNKVISSRGFPFENSSSRCSQTQENTECTVCLFLVQKKPLIFL
GCCFFSTLVLLLSIAIFQRQKRRKFWKAKNLQHIPLKKGKRVVS
```

(viii) huBeta_Klotho(1-507, 635-1044)(muBeta KLOTHO F06-G632)
(SEQ ID NO: 462)

```
MKPGCAAGSPGNEWIFFSTDEITTRYRNTMSNGGLQRSVILSALILLRAV
TGFSGDGRAIWSKNPNFTPVNESQLFLYDTFPKNFFWGIGTGALQVEGSW
KKDGKGPSIWDHFIHTHLKNVSSTNGSSDSYIFLEKDLSALDFIGVSFYQ
FSISWPRLFPDGIVTVANAKGLQYYSTLLDALVLRNIEPIVTLYHWDLPL
ALQEKYGGWKNDTIIDIFNDYATYCFQMFGDRVKYWITIHNPYLVAWHGY
GTGMHAPGEKGNLAAVYTVGHNLIKAHSKVWHNYNTHFRPHQKGWLSITL
GSHWIEPNRSENTMDIFKCQQSMVSVLGWFANPIHGDGDYPEGMRKKLFS
VLPIFSEAEKHEMRGTADFFAFSFGPNNFKPLNTMAKMGQNVSLNLREAL
NWIKLEYNNPRILIAENGWFTDSRVKTEDTTAIYMMKNFLSQVLQAIRLD
EIRVFGYTAWSLLDGFEWQDAYTIRRGLFYVDFNSKQKERKPKSSAHYYK
QIIRENGFPLKESTPDMKGRFPCDFSWGVTESVLKPEFTVSSPQFTDPHL
YVWNVTGNRLLYRVEGVRLKTRPSQCTDYVSIKKRVEMLAKMKVTHYQFA
LDWTSILPTGNLSKVNRQVLRYYRCVVSEGLKLGISAMVTLYYPTHAHLG
```

-continued
```
      LPEPLLHADGWLNPSTAEAFQAYAGLCFQELGDLVKLWITINEPNRLSDI
      YNRSGNDTYGAAHNLLVAHALAWRLYDQQFRPSQRGAVSLSLHADWAEPA
      NPYADSHWRAAERFLQFEIAWFAEPLFKTGDYPAAMREYIASKHRRGLSS
      SALPRLTEAERRLLKGTVDFCALNHFTTRFVMHEQLAGSRYDSDRDIQFL
      QDITRLSSPTRLAVIPWGVRKLLRWVRRNYGDMDIYITASGIDDQALEDD
      RLRKYYLGKYLQEVLKAYLIDKVRIKGYYAFKLAEEKSKPRFGFFTSDFK
      AKSSIQFYNKVISSRGFPPENSSSRCSQTQENTECTVCLFLVQKKPLIFL
      GCCFFSTLVLLLSIAIFQRQKRRKFWKAKNLQHIPLKKGKRVVS (ix)  huBeta_Klotho(1-521, 738-1044)(muBeta KLOTHO 520P-735A)
                                             (SEQ ID NO: 463)
      MKPGCAAGSPGNEWIFFSTDEITTRYRNTMSNGGLQRSVILSALILLRAV
      TGFSGDGRAIWSKNPNFTPVNESQLFLYDTFPKNFFWGIGTGALQVEGSW
      KKDGKGPSIWDHFIHTHLKNVSSTNGSSDSYIFLEKDLSALDFIGVSFYQ
      FSISWPRLFPDGIVTVANAKGLQYYSTLLDALVLRNIEPIVTLYHWDLPL
      ALQEKYGGWKNDTIIDIFNDYATYCFQMFGDRVKYWITIHNPYLVAWHGY
      GTGMHAPGEKGNLAAVYTVGHNLIKAHSKVWHNYNTHFRPHQKGWLSITL
      GSHWIEPNRSENTMDIFKCQQSMVSVLGWFANPIHGDGDYPEGMRKKLFS
      VLPIFSEAEKHEMRGTADFFAFSFGPNNFKPLNTMAKMGQNVSLNLREAL
      NWIKLEYNNPRILIAENGWFTDSRVKTEDTTAIYMMKNFLSQVLQAIRLD
      EIRVFGYTAWSLLDGFEWQDAYTIRRGLFYVDFNSKQERKPKSSAHYYK
      QIIRENGFSLKESTPDVQGQFPCDFSWGVTESVLKPEFTVSSPQFTDPHL
      YVWNVTGNRLLYRVEGVRLKTRPSQCTDYVSIKKRVEMLAKMKVTHYQFA
      LDWTSILPTGNLSKVNRQVLRYYRCVVSEGLKLGVFPMVTLYHPTHSHLG
      LPLPLLSSGGWLNMNTAKAFQDYAELCFRELGDLVKLWITINEPNRLSDM
      YNRTSNDTYRAAHNLMIAHAQVWHLYDRQYRPVQHGAVSLSLHADWAEPA
      NPYADSHWRAAERFLQFEIAWFAEPLFKTGDYPAAMREYIASKHRRGLSS
      SALPRLTEAERRLLKGTVDFCALNHFTTRFVMHEQLAGSRYDSDRDIQFL
      QDITRLSSPTRLAVIPWGVRKLLRWVRRNYGDMDIYITASGIDDQALEDD
      RLRKYYLGKYLQEVLKAYLIDKVRIKGYYAFKLAEEEKSKPRFGFFTSDFK
      AKSSIQFYNKVISSRGFPPENSSSRCSQTQENTECTVCLFLVQKKPLIFL
      GCCFFSTLVLLLSIAIFQRQKRRKFWKAKNLQHIPLKKGKRVVS (x)   huBeta_Klotho(1-633, 852-1044)(muBeta KLOTHO 632G-849Q)
                                             (SEQ ID NO: 464)
      MKPGCAAGSPGNEWIFFSTDEITTRYRNTMSNGGLQRSVILSALILLRAV
      TGFSGDGRAIWSKNPNFTPVNESQLFLYDTFPKNFFWGIGTGALQVEGSW
      KKDGKGPSIWDHFIHTHLKNVSSTNGSSDSYIFLEKDLSALDFIGVSFYQ
      FSISWPRLFPDGIVTVANAKGLQYYSTLLDALVLRNIEPIVTLYHWDLPL
      ALQEKYGGWKNDTIIDIFNDYATYCFQMFGDRVKYWITIHNPYLVAWHGY
      GTGMHAPGEKGNLAAVYTVGHNLIKAHSKVWHNYNTHFRPHQKGWLSITL
      GSHWIEPNRSENTMDIFKCQQSMVSVLGWFANPIHGDGDYPEGMRKKLFS
      VLPIFSEAEKHEMRGTADFFAFSFGPNNFKPLNTMAKMGQNVSLNLREAL
      NWIKLEYNNPRILIAENGWFTDSRVKTEDTTAIYMMKNFLSQVLQAIRLD
      EIRVFGYTAWSLLDGFEWQDAYTIRRGLFYVDFNSKQERKPKSSAHYYK
      QIIRENGFSLKESTPDVQGQFPCDFSWGVTESVLKPESVASSPQFSDPHL
      YVWNATGNRLLHRVEGVRLKTRPAQCTDFVNIKKQLEMLARMKVTHYRFA
      LDWASVLPTGNLSAVNRQALRYYRCVVSEGLKLGVFPMVTLYHPTHSHLG
      LPLPLLSSGGWLNMNTAKAFQDYAELCFRELGDLVKLWITINEPNRLSDM
      YNRTSNDTYRAAHNLMIAHAQVWHLYDRQYRPVQHGAVSLSLHCDWAEPA
      NPFVDSHWKAAERFLQFEIAWFADPLFKTGDYPSVMKEYIASKNQRGLSS
      SVLPRFTAKESRLVKGTVDFYALNHFTTRFVIHKQLNTNRSVADRDVQFL
      QDITRLSSPTRLAVIPWGVRKLLRWVRRNYGDMDIYITASGIDDQALEDD
      RLRKYYLGKYLQEVLKAYLIDKVRIKGYYAFKLAEEEKSKPRFGFFTSDFK
      AKSSIQFYNKVISSRGFPPENSSSRCSQTQENTECTVCLFLVQKKPLIFL
      GCCFFSTLVLLLSIAIFQRQKRRKFWKAKNLQHIPLKKGKRVVS (xi)  huBeta_Klotho(1-736, 967-1044)(muBeta KLOTHO 735A-963S)
                                             (SEQ ID NO: 465)
      MKPGCAAGSPGNEWIFFSTDEITTRYRNTMSNGGLQRSVILSALILLRAV
      TGFSGDGRAIWSKNPNFTPVNESQLFLYDTFPKNFFWGIGTGALQVEGSW
      KKDGKGPSIWDHFIHTHLKNVSSTNGSSDSYIFLEKDLSALDFIGVSFYQ
      FSISWPRLFPDGIVTVANAKGLQYYSTLLDALVLRNIEPIVTLYHWDLPL
      ALQEKYGGWKNDTIIDIFNDYATYCFQMFGDRVKYWITIHNPYLVAWHGY
      GTGMHAPGEKGNLAAVYTVGHNLIKAHSKVWHNYNTHFRPHQKGWLSITL
      GSHWIEPNRSENTMDIFKCQQSMVSVLGWFANPIHGDGDYPEGMRKKLFS
      VLPIFSEAEKHEMRGTADFFAFSFGPNNFKPLNTMAKMGQNVSLNLREAL
      NWIKLEYNNPRILIAENGWFTDSRVKTEDTTAIYMMKNFLSQVLQAIRLD
      EIRVFGYTAWSLLDGFEWQDAYTIRRGLFYVDFNSKQERKPKSSAHYYK
      QIIRENGFSLKESTPDVQGQFPCDFSWGVTESVLKPESVASSPQFSDPHL
      YVWNATGNRLLHRVEGVRLKTRPAQCTDFVNIKKQLEMLARMKVTHYRFA
      LDWASVLPTGNLSAVNRQALRYYRCVVSEGLKLGISAMVTLYYPTHAHLG
      LPEPLLHADGWLNPSTAEAFQAYAGLCFQELGDLVKLWITINEPNRLSDI
      YNRSGNDTYGAAHNLLVAHALAWRLYDQQFRPSQRGAVSLSLHCDWAEPA
      NPFVDSHWKAAERFLQFEIAWFADPLFKTGDYPSVMKEYIASKNQRGLSS
      SVLPRFTAKESRLVKGTVDFYALNHFTTRFVIHKQLNTNRSVADRDVQFL
      QDITRLSSPSRLAVTPWGVRKLLAWIRRNYRDRDIYITANGIDDLALEDD
      QIRKYYLEKYVQEALKAYLIDKVKIKGYYAFKLTEEKSKPRFGFFTSDFR
      AKSSVQFYSKLISSSGFPPENSSSRCSQTQENTECTVCLFLVQKKPLIFL
      GCCFFSTLVLLLSIAIFQRQKRRKFWKAKNLQHIPLKKGKRVVS
```

Figure 30:
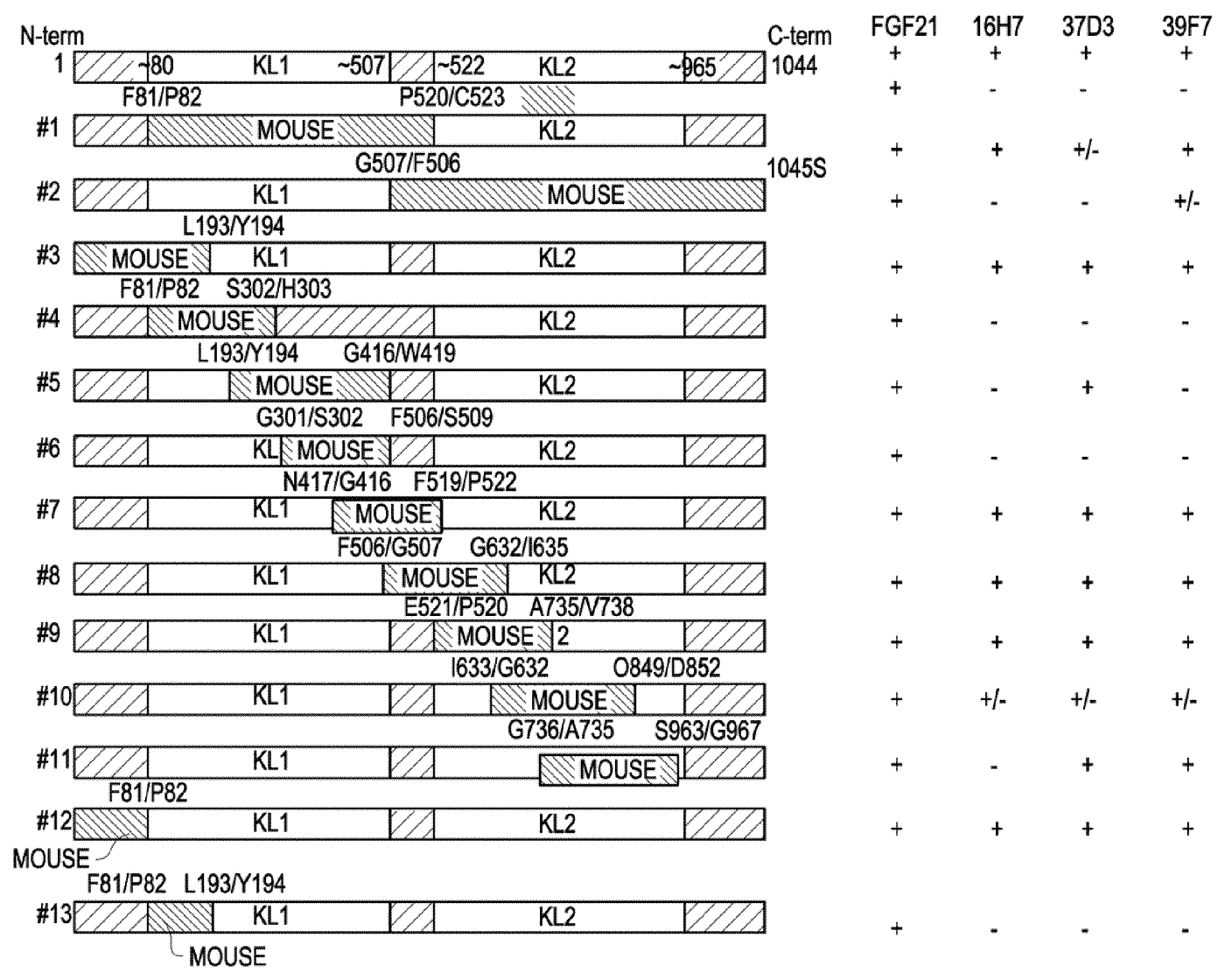

-continued (xii) huBeta_Klotho(82-1044)(muBeta KLOTHO 1-81F)
(SEQ ID NO: 466)
MKTGCAAGSPGNEWIFFSSDERNTRSRKTMSNRALQRSAVLSAFVLLRAV
TGFSGDGKAIWDKKQYVSPVNPSQLFLYDTFPKNFFWGIGTGALQVEGSW
KKDGKGPSIWDHFIHTHLKNVSSTNGSSDSYIFLEKDLSALDFIGVSFYQ
FSISWPRLFPDGIVTVANAKGLQYYSTLLDALVLRNIEPIVTLYHWDLPL
ALQEKYGGWKNDTIIDIFNDYATYCFQMFGDRVKYWITIHNPYLVAWHGY
GTGMHAPGEKGNLAAVYTVGHNLIKAHSKVWHNYNTHFRPHQKGWLSITL
GSHWIEPNRSENTMDIFKCQQSMVSVLGWFANPIHGDGDYPEGMRKKLFS
VLPIFSEAEKHEMRGTADFFAFSFGPNNFKPLNTMAKMGQNVSLNLREAL
NWIKLEYNNPRILIAENGWFTDSRVKTEDTTAIYMMKNFLSQVLQAIRLD
EIRVFGYTAWSLLDGFEWQDAYTIRRGLFYVDFNSKQKERKPKSSAHYYK
QIIRENGFSLKESTPDVQGQFPCDFSWGVTESVLKPESVASSPQFSDPHL
YVWNATGNRLLHRVEGVRLKTRPAQCTDFVNIKKQLEMLARMKVTHYRFA
LDWASVLPTGNLSAVNRQALRYYRCVVSEGLKLGISAMVTLYYPTHAHLG
LPEPLLHADGWLNPSTAEAFQAYAGLCFQELGDLVKLWITINEPNRLSDI
YNRSGNDTYGAAHNLLVAHALAWRLYDQQFRPSQRGAVSLSLHADWAEPA
NPYADSHWRAAERFLQFEIAWFAEPLFKTGDYPAAMREYIASKHRRGLSS
SALPRLTEAERRLLKGTVDFCALNHFTTRFVMHEQLAGSRYDSDRDIQFL
QDITRLSSPTRLAVIPWGVRKLLRWVRRNYGDMDIYITASGIDDQALEDD
RLRKYYLGKYLQEVLKAYLIDKVRIKGYYAFKLAEEKSKPRFGFFTSDFK
AKSSIQFYNKVISSRGFPPFENSSSRCSQTQENTECTVCLFLVQKKPLIFL
GCCFFSTLVLLLSIAIFQRQKRRKFWKAKNLQHIPLKKGKRVVS (xiii) huBeta_Klotho(1-81, 194-1044)(muBeta KLOTHO 82P-193L)
(SEQ ID NO: 467)
MKPGCAAGSPGNEWIFFSTDEITTRYRNTMSNGGLQRSVILSALILLRAV
TGFSGDGRAIWSKNPNFTPVNESQLFLYDTFPKNFSWGVGTGAFQVEGSW
KTDGRGPSIWDRYVYSHLRGVNGTDRSTDSYIFLEKDLLALDFLGVSFYQ
FSISWPRLFPNGTVAAVNAQGLRYYRALLDSLVLRNIEPIVTLYHWDLPL
ALQEKYGGWKNDTIIDIFNDYATYCFQMFGDRVKYWITIHNPYLVAWHGY
GTGMHAPGEKGNLAAVYTVGHNLIKAHSKVWHNYNTHFRPHQKGWLSITL
GSHWIEPNRSENTMDIFKCQQSMVSVLGWFANPIHGDGDYPEGMRKKLFS
VLPIFSEAEKHEMRGTADFFAFSFGPNNFKPLNTMAKMGQNVSLNLREAL
NWIKLEYNNPRILIAENGWFTDSRVKTEDTTAIYMMKNFLSQVLQAIRLD
EIRVFGYTAWSLLDGFEWQDAYTIRRGLFYVDFNSKQKERKPKSSAHYYK
QIIRENGFSLKESTPDVQGQFPCDFSWGVTESVLKPESVASSPQFSDPHL
YVWNATGNRLLHRVEGVRLKTRPAQCTDFVNIKKQLEMLARMKVTHYRFA
LDWASVLPTGNLSAVNRQALRYYRCVVSEGLKLGISAMVTLYYPTHAHLG
LPEPLLHADGWLNPSTAEAFQAYAGLCFQELGDLVKLWITINEPNRLSDI
YNRSGNDTYGAAHNLLVAHALAWRLYDQQFRPSQRGAVSLSLHADWAEPA
NPYADSHWRAAERFLQFEIAWFAEPLFKTGDYPAAMREYIASKHRRGLSS
SALPRLTEAERRLLKGTVDFCALNHFTTRFVMHEQLAGSRYDSDRDIQFL
QDITRLSSPTRLAVIPWGVRKLLRWVRRNYGDMDIYITASGIDDQALEDD
RLRKYYLGKYLQEVLKAYLIDKVRIKGYYAFKLAEEKSKPRFGFFTSDFK
AKSSIQFYNKVISSRGFPPFENSSSRCSQTQENTECTVCLFLVQKKPLIFL
GCCFFSTLVLLLSIAIFQRQKRRKFWKAKNLQHIPLKKGKRVVS Various antigen binding proteins provided herein, as well as human FGF21, were tested for the ability to activate the chimeras in L6 cells. FIG. 30 correlates the observed results with each tested molecule.

These data indicate that while human FGF21 was able to activate FGFR1c combined with all of the human/mouse β-Klotho chimeras ("+" sign indicate activity on the receptor), the substitutions of mouse sequences into human β-Klotho affected the activities of 16H7, 37D3, and 39F7. See FIG. 30. These results suggest that β-Klotho sequences 1-81, 302-522, and 849-1044 are important for the activities of agonistic antigen binding proteins and may represent an important epitope for their function.

Example 12

Protease Protection Analysis

Regions of the human FGF21 receptor bound by the antigen binding proteins that bind human FGF21 receptor, e.g., FGFR1c, β-Klotho or FGFR1c and β-Klotho complex can be identified by fragmenting human FGF21 receptor into peptides with specific proteases, e.g., AspN, Lys-C, chymotrypsin or trypsin. The sequence of the resulting human FGF21 receptor peptides (i.e., both disulfide- and non-disulfide-containing peptide fragments from FGFR1c and β-Klotho portions) can then be determined. In one example, soluble forms of a human FGF21 receptor, e.g., a complex comprising the FGFR1c ECD-Fc and β-Klotho ECD-Fc heterodimer described herein can be digested with AspN (which cleaves after aspartic acid and some glutamic acid residues at the amino end) by incubating about 100 µg of soluble FGF21 receptor at 1.0 mg/ml in 0.1M sodium phosphate (pH 6.5) for 20 hrs at 37° C. with 2 µg of AspN.

A peptide profile of the AspN digests can then be generated on HPLC chromatography while a control digestion with a similar amount of antibody is expected to be essentially resistant to AspN endoprotease. A protease protection assay can then be performed to determine the proteolytic digestion of human FGF21 receptor in the presence of the antigen binding proteins. The general principle of this assay is that binding of an antigen binding protein to the FGF21 receptor can result in protection of certain specific protease cleavage sites and this information can be used to determine the region or portion of FGF21 receptor where the antigen binding protein binds.

Briefly, the peptide digests can be subjected to HPLC peptide mapping; the individual peaks are collected, and the peptides are identified and mapped by on-line electrospray ionization LC-MS (ESI-LC-MS) analyses and/or by N-terminal sequencing. HPLC analyses for these studies can be performed using a narrow bore reverse-phase C18 column (Agilent Technologies) for off-line analysis and using a capillary reverse phase C18 column (The Separation Group) for LC-MS. HPLC peptide mapping can be performed with a linear gradient from 0.05% trifluoroacetic acid (mobile phase A) to 90% acetonitrile in 0.05% trifluoroacetic acid. Columns can be developed at desirable flow rate for narrow bore HPLC for off-line or on-line LC-MS analyses, and for capillary HPLC for on-line LC-MS analyses.

Sequence analyses can be conducted by on-line LC-MS/MS and by Edman sequencing on the peptide peaks recovered from HPLC. On-line ESI LC-MS analyses of the peptide digest can be performed to determine the precise mass and sequence of the peptides that are separated by HPLC. The identities of selected peptides present in the peptide peaks from the protease digestion can thus be determined.

Example 13

Cynomolgous Monkey Study

A construct encoding the antigen binding protein designated herein as 16H7 was generated using the methodology disclosed in Examples 1-3. 16H7 was expressed, purified and characterized as described in Examples 1-5 and was studied in vivo in obese cynomolgus monkeys. 16H7 is a fully human IgG1 antibody and is described by the sequences provided in Tables 1-4, supra.

Example 13.1

Study Design

The study was conducted in obese cynomolgus monkeys. The monkeys were 8-19 years old. Their body weights ranged from 7-14 kg and BMI ranged from 36-74 kg/m$^2$. Monkeys were acclimated for 6 weeks prior to the initiation of compound administration. During the acclimation period, the monkeys were familiarized with study-related procedures, including chair-restraint, subcutaneous injection (PBS, 0.1 ml/kg), gavage (water, 10 ml/kg), and blood drawn for non-OGTT and OGTT samples. After 4 weeks of training, baseline OGTT and plasma metabolic parameters were measured. 20 monkeys were selected and randomized into two treatment groups to achieve similar baseline levels of body weight, glucose OGTT profiles, and plasma glucose and triglyceride levels.

The study was conducted in a blinded fashion. Vehicle (n=10), 16H7 (n=10). Compound was given every other week (5 mg/kg). On the week when animals were not injected with 16H7, they received vehicle injection instead. After 2 injections of 16H7, animals were monitored during an additional 6 weeks for compound washout and recovery from treatments. Food intake, body weight, clinical chemistry and OGTT were monitored throughout the study. Food intake was measured every meal. Body weight was measured weekly. Blood samples were collected on different days in fasted or fed state to measure glucose, insulin and triglyceride levels. OGTTs were conducted every two weeks after the initiation of the study. The day starting the treatment is designated as 0 and the detailed study plan is shown in FIG. 14.

The results presented in this Example represent data collected throughout the 68 days of the study.

Example 13.2

Effect of 16H7 on Food Intake

Animals were fed twice a day, with each animal receiving 120 g of formulated food established during the acclimation period. The remaining food was removed and weighed after each meal to calculate food intake. The feeding times were from 8:00 AM to 8:30 AM (±30 minutes) and then from 4:30 PM to 5:00 PM (±30 minutes). Fruit (150 g) was supplied to each animal at 11:30 to 12:30 PM (±30 minutes) every day.

Figure 15:
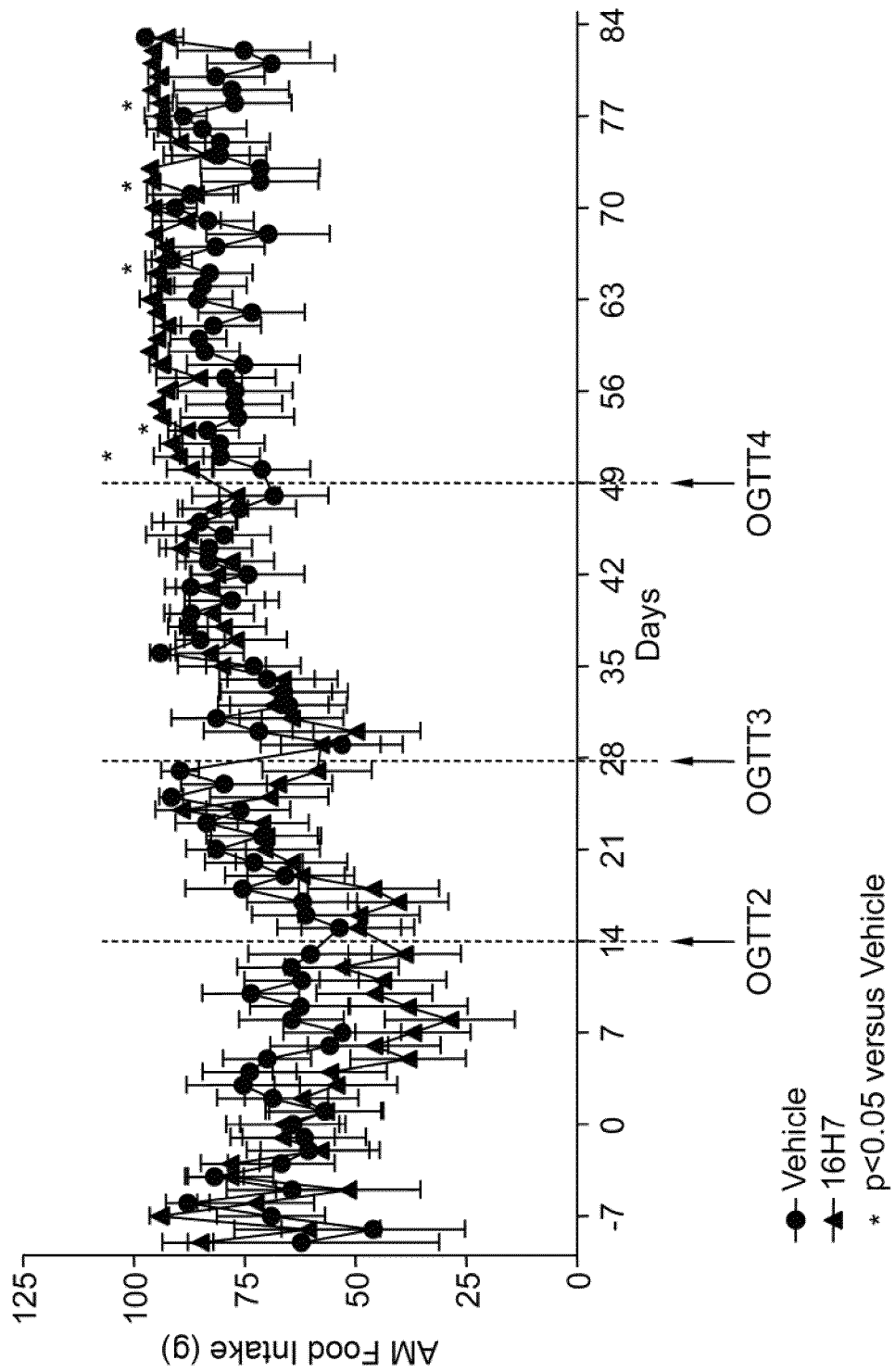
FIG. 15 is a plot depicting the effects of vehicle and 16H7 on AM meal food intake of the obese cynomolgus monkeys studied.
Figure 16A:
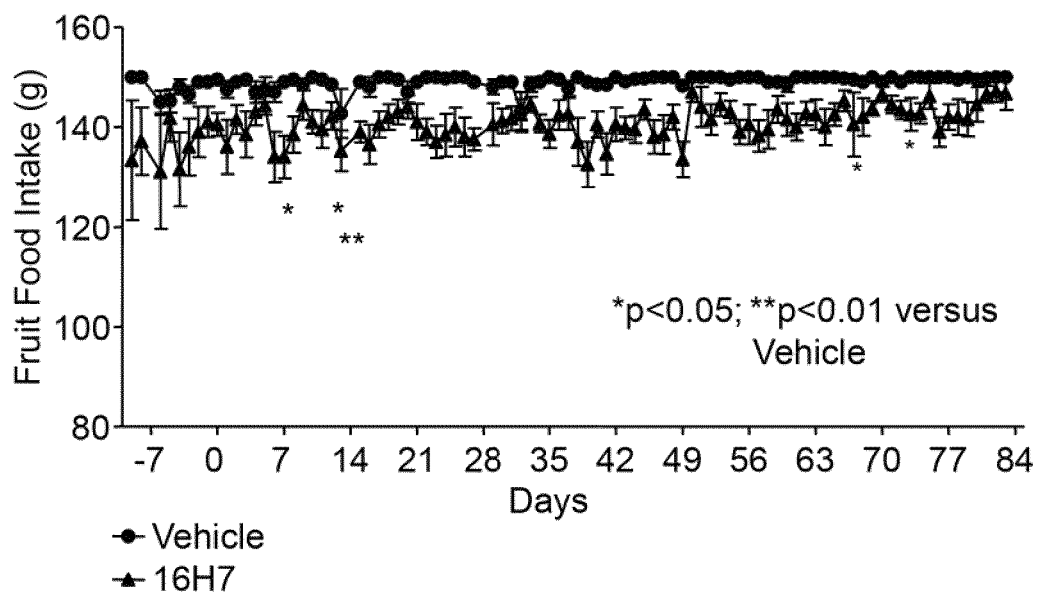
FIGS. 16A-16B are two plots depicting the effects of vehicle and 16H7 on fruit intake and PM food intake of the obese cynomolgus monkeys studied.
Figure 16B:
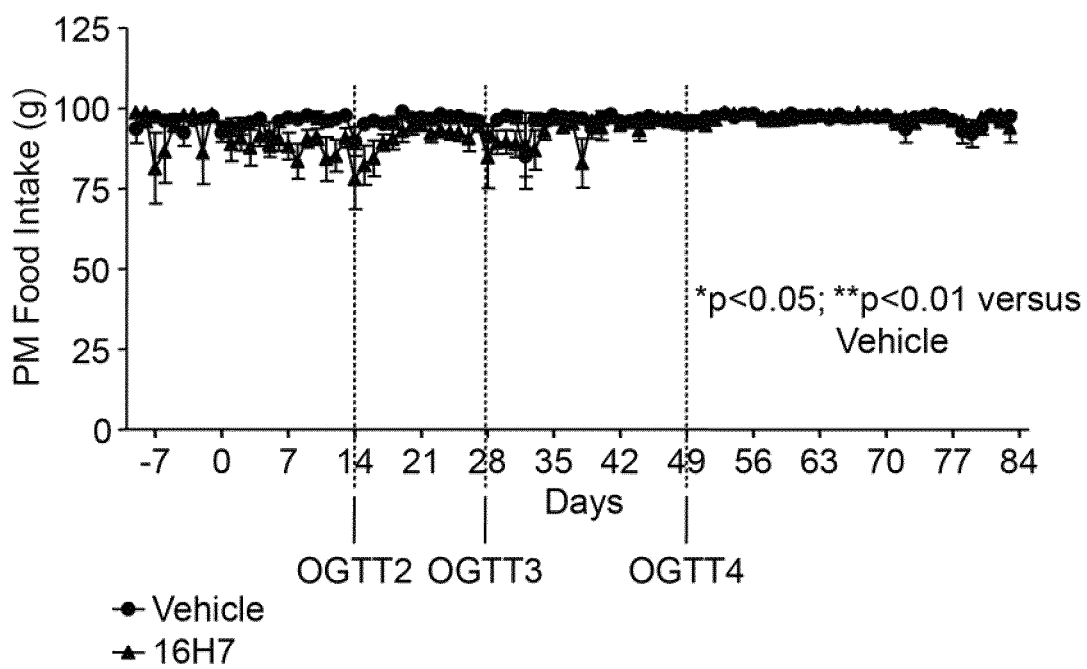

Compared with vehicle, 16H7 reduced food intake in the monkeys. The effect diminished and the food intake returned to close to baseline or control levels after about 21 days of treatment. 16H7 did not have a significant effect on AM food intake (FIG. 15) and only modestly reduced food intake on PM meal during the treatment (FIG. 16). An increase in AM food intake was seen after day 49 (FIG. 15). Throughout the study (and even during the acclimation period), fruit intake seemed lower in the 16H7 group compared to the vehicle group. Overall, 16H7 showed a significant effect on inhibiting food intake.

Example 13.3

Effect of 16H7 on Body Weight

Figure 17A:
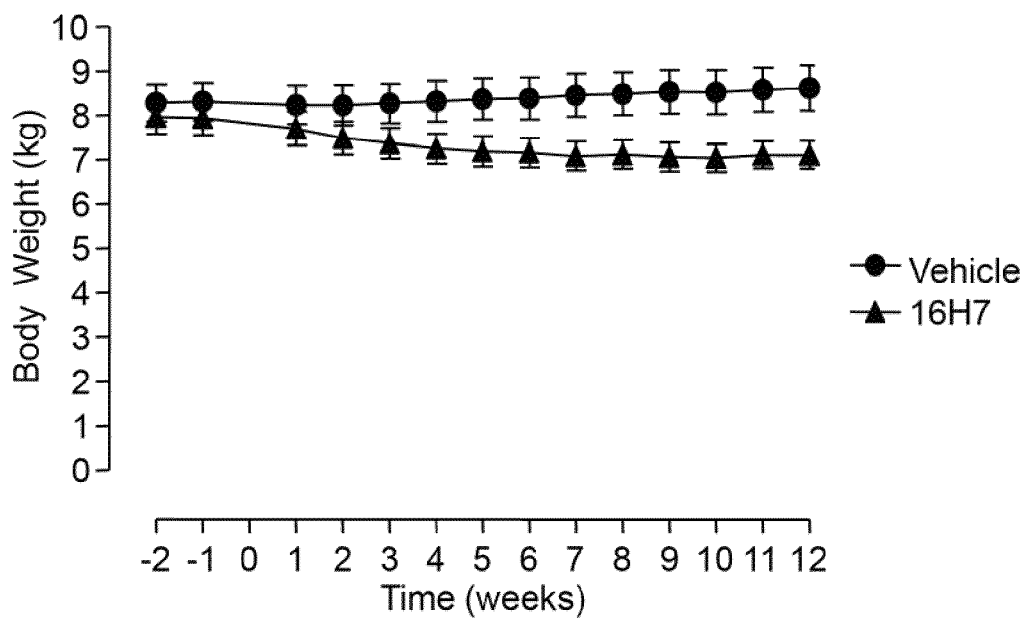
FIGS. 17A-17B are a plot depicting the effects of vehicle and 16H7 on body weight of the obese cynomolgus monkeys studied.
Figure 17B:
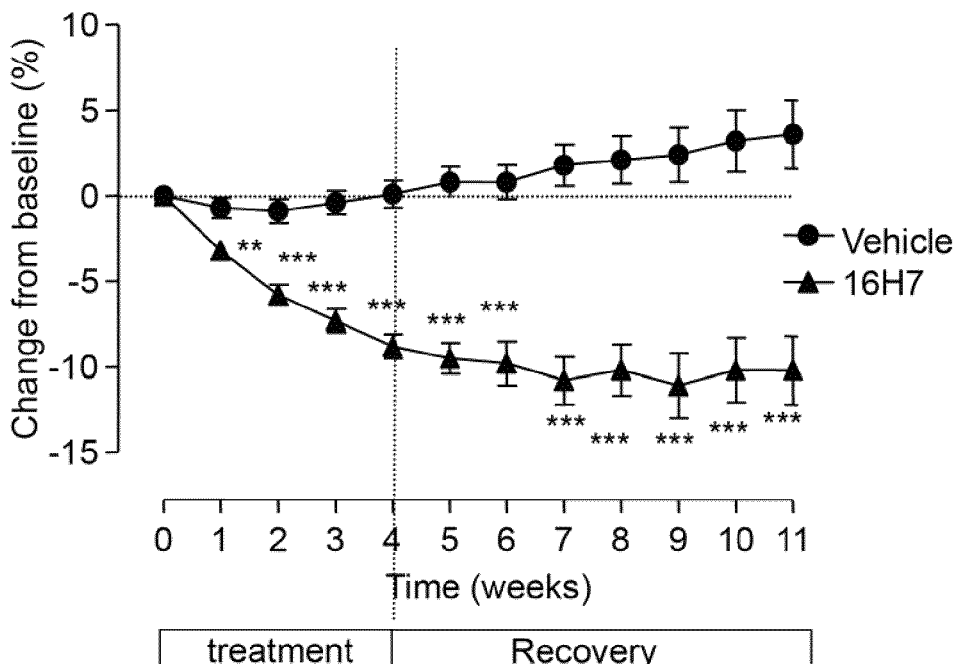

Body weight was monitored weekly throughout the study. Over the course of the 4 week treatments, the body weight of animals treated with vehicle remained constant while body weight of animals treated with 16H7 progressively decreased. Body weight did not return to baseline by the end of the 6 weeks wash out period (FIG. 17).

Example 13.4

Effect of 16H7 on Body Mass Index (BMI), Abdominal Circumference (AC) and Skin Fold Thickness (SFT)

Figure 18A:
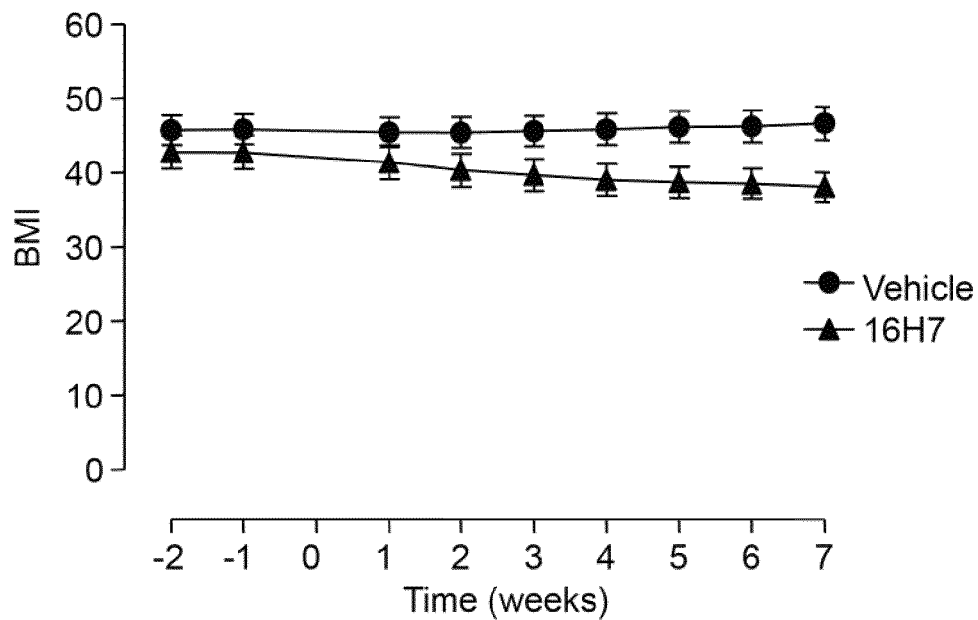
FIGS. 18A-18B are a plot showing the effects of vehicle and 16H7 on body mass index (BMI) of the obese cynomolgus monkeys studied.
Figure 18B:
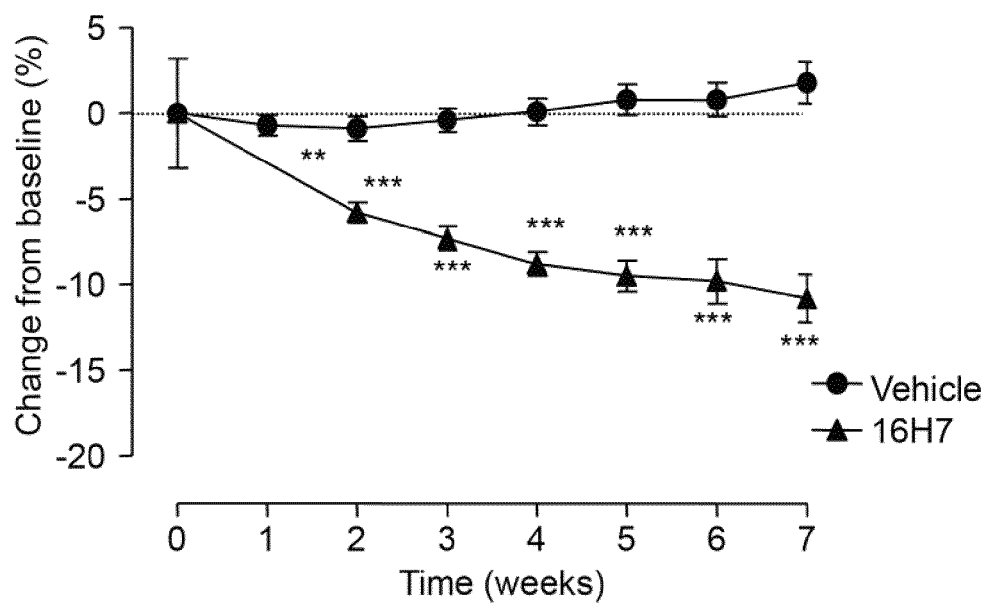
Figure 19A:
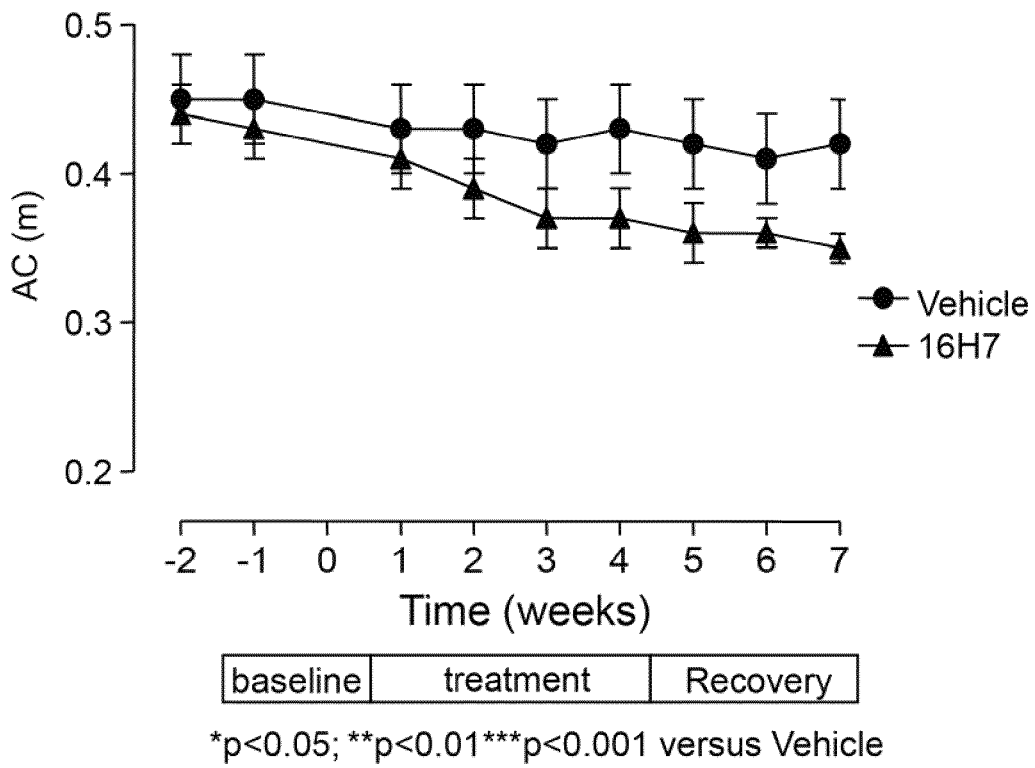
FIGS. 19A-19B are a plot showing the effects of vehicle on abdominal circumference (AC) of the obese cynomolgus monkeys studied.
Figure 19B:
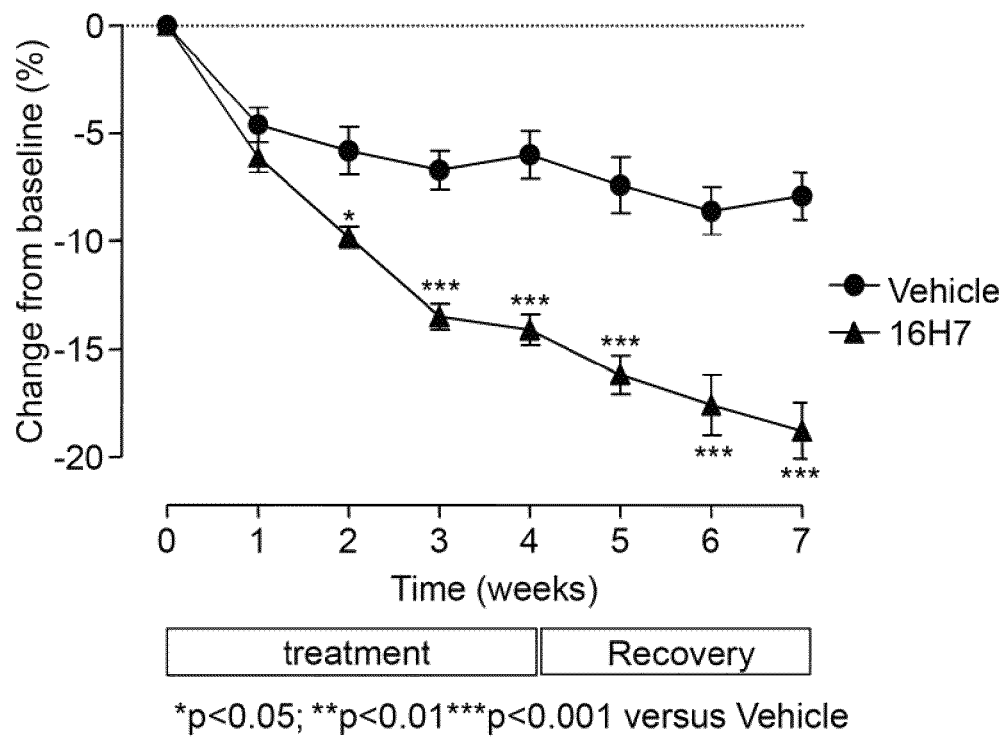
Figure 20A:
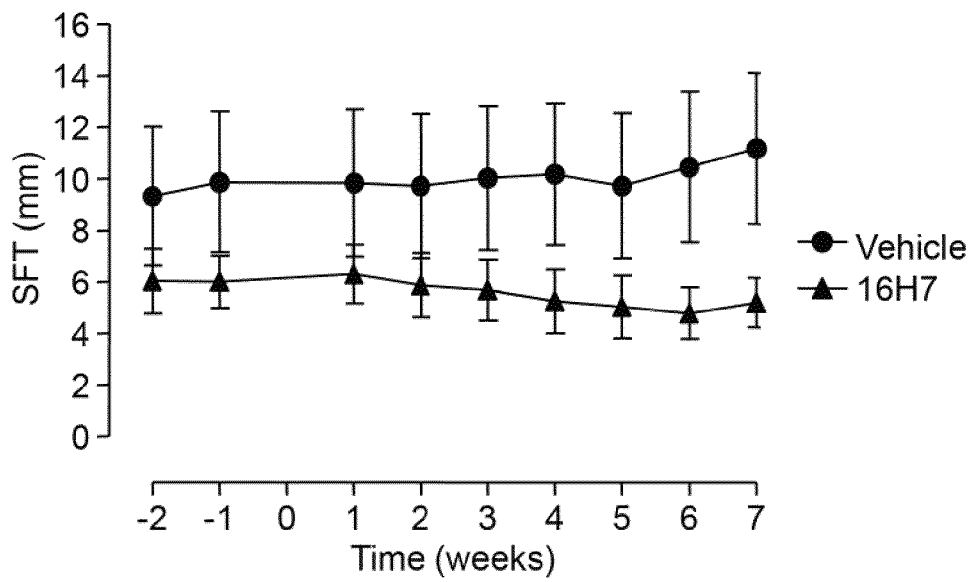
FIGS. 20A-20B are a plot showing the effects of vehicle and 16H7 on skin fold thickness (SFT) of the obese cynomolgus monkeys studied.
Figure 20B:
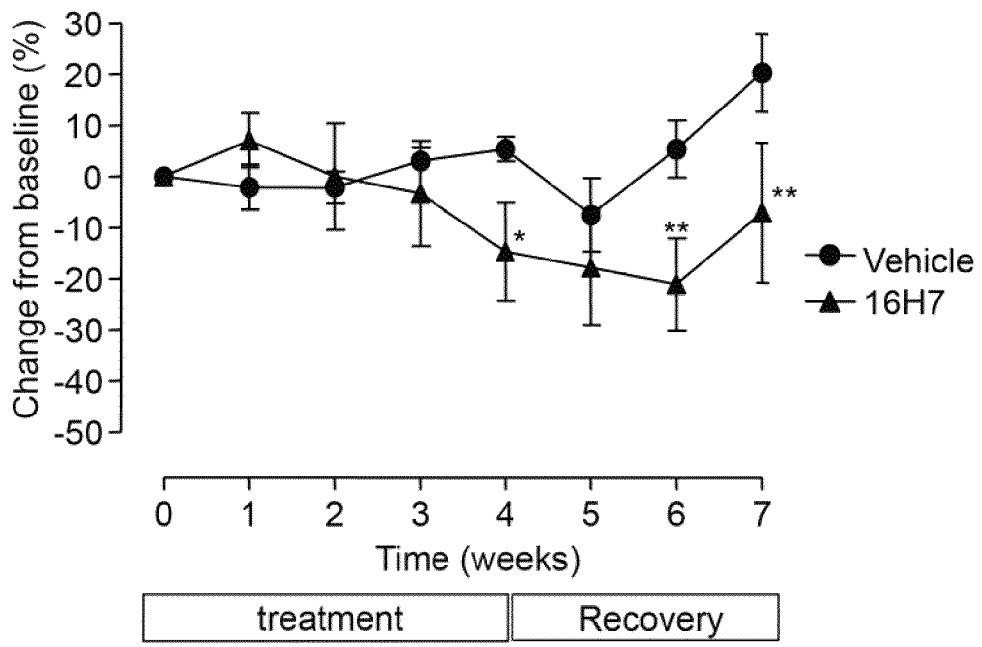
Figure 21A:
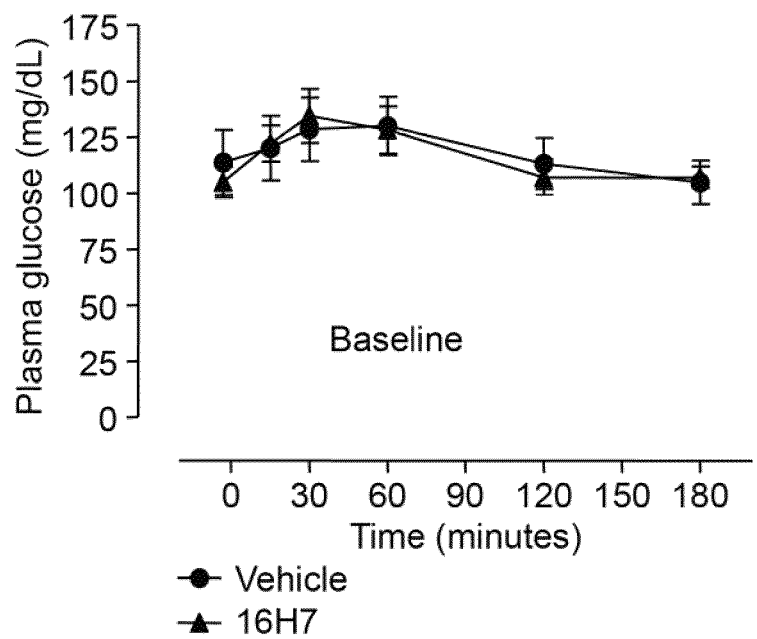
FIGS. 21A-21D are a plot showing the effects of vehicle and 16H7 on glucose levels during glucose tolerance tests of the obese cynomolgus monkeys studied.
Figure 21B:
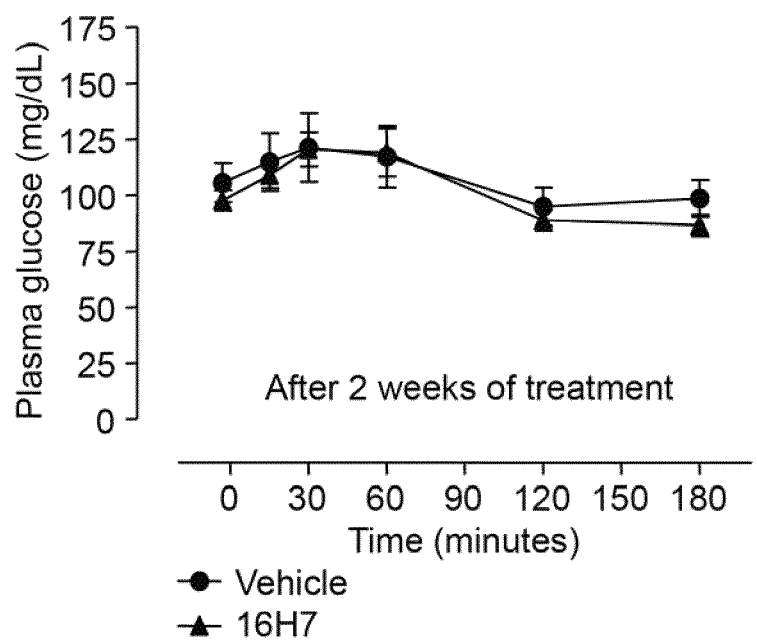
Figure 21C:
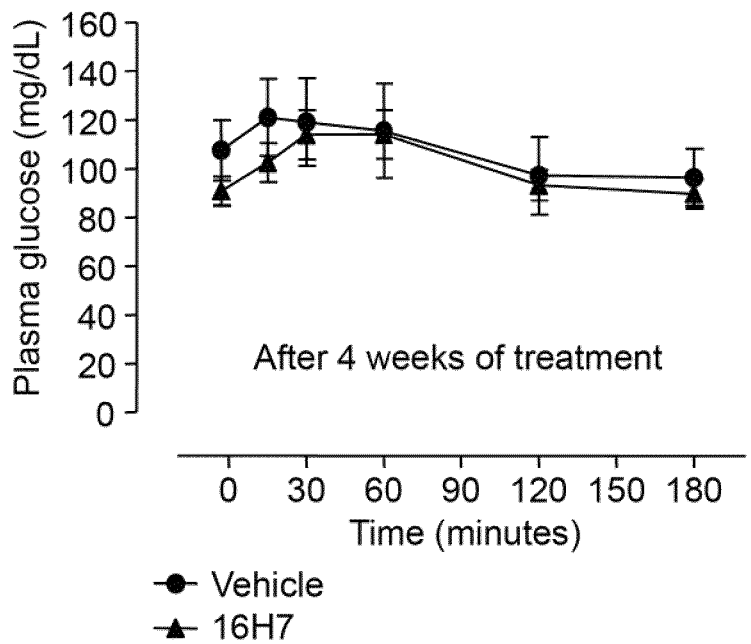
Figure 21D:
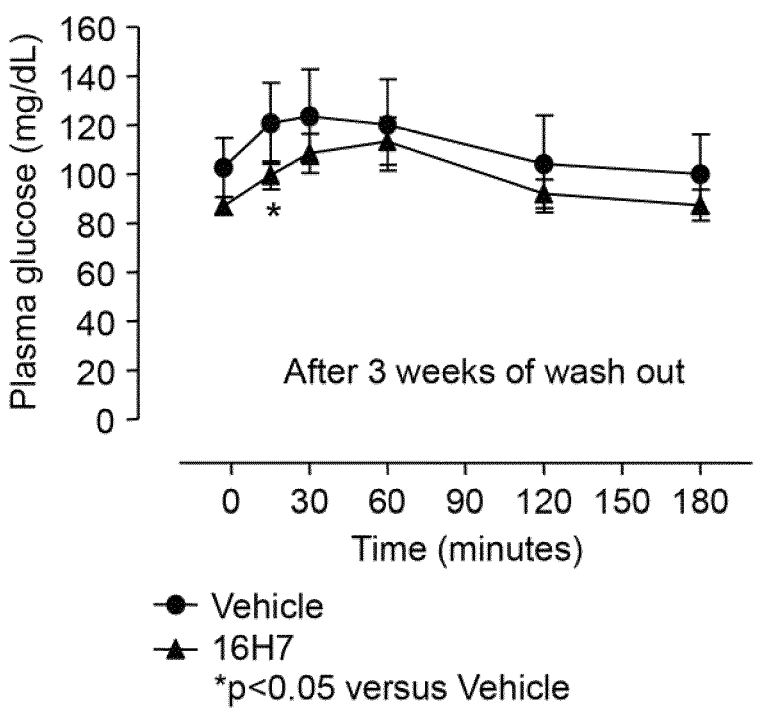
Figure 22A:
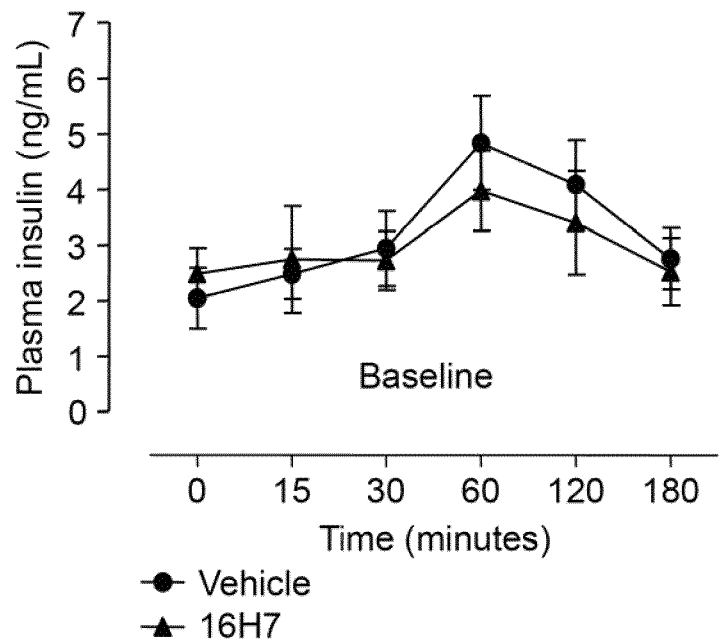
FIGS. 22A-22D are a plot showing the effects of vehicle and 16H7 on plasma insulin levels during glucose tolerance tests of the obese cynomolgus monkeys studied.
Figure 22B:
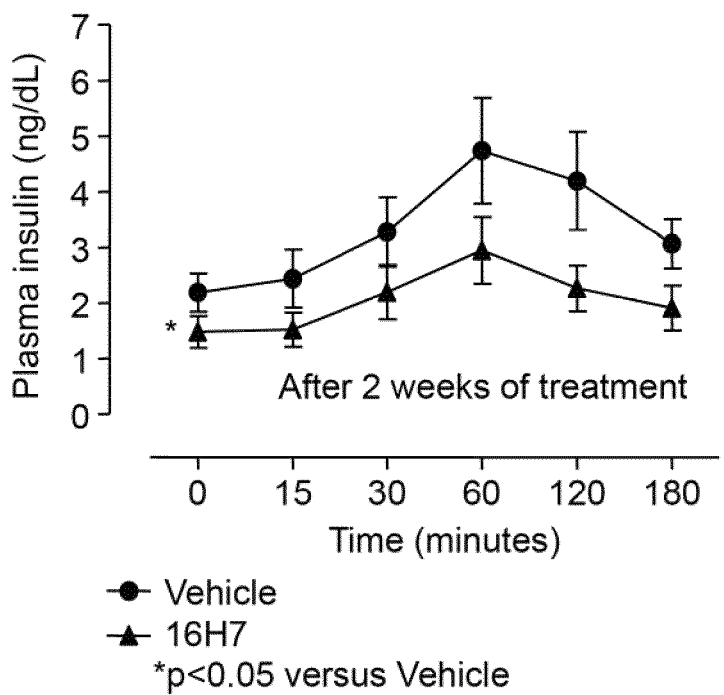
Figure 22C:
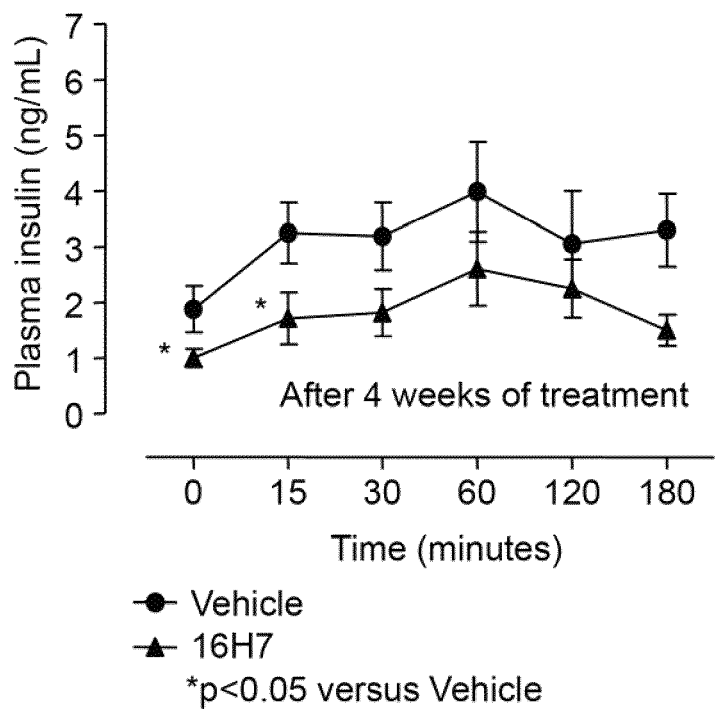
Figure 22D:
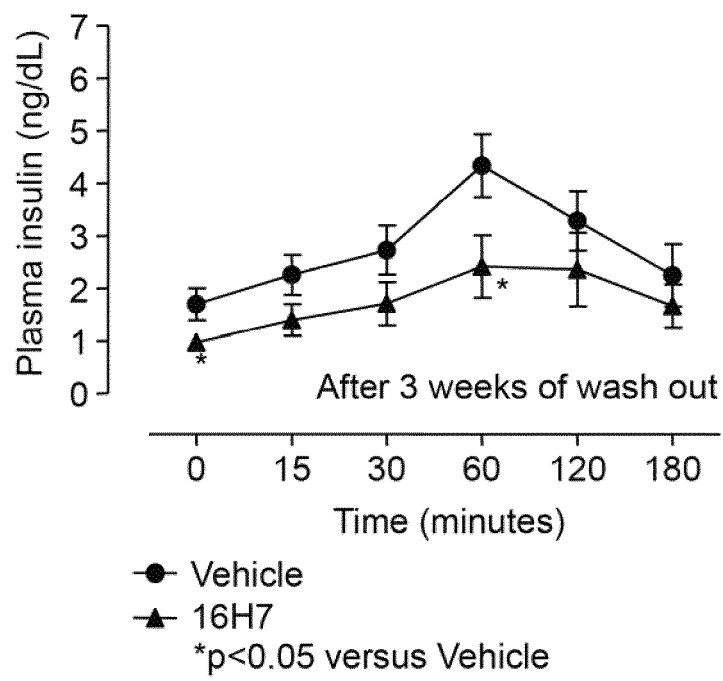

BMI, AC and SFT were monitored weekly throughout the study, both pre- and post-administration of test compound when the body weight was taken. BMI is defined as the individual's body weight divided by the square of his or her height. SFT is the thickness of a double layer of skin and the fat beneath it as measured with a caliper. BMI, SFT and AC are relatively accurate, simple, and inexpensive measurements of body composition, particularly indicative of subcutaneous fat. Animals treated with vehicle showed relatively stable BMI, SFT and AC throughout the study. Animals treated with 16H7 showed decreased levels of BMI, AC and SFT over the course of the 4 week study, suggesting that 16H7 compound resulted in reduction of fat mass. Results are shown in FIGS. 18-20, respectively. These measured parameters did not come back to baseline values at the end of the 6 weeks wash out period.

Example 13.5

Effect of 16H7 on Oral Glucose Tolerance Test (OGTT)

OGTTs were conducted before and after initiation of treatments. Before 16H7 injections baseline values for glucose and insulin levels were measured throughout the OGTT (FIGS. 21 and 22, respectively) and were not statistically significantly different between the vehicle and 16H7 groups. Post-dose OGTTs were performed every two weeks during the treatment period and after 3 weeks of wash out period. 16H7 slightly improved glucose tolerance after 4 weeks of treatment and 3 weeks of wash out period. The animal model used is not glucose intolerant explaining the modest effects observed (FIG. 21). Insulin levels were statistically significantly decreased in animals treated with 16H7 (significance observed at time 0 during the OGTT performed after 2 weeks of treatment, at time 0 and 15 minutes during the OGTT performed after 4 weeks of treatment and at time 0 and 60 minutes during the OGTT performed after 2 weeks of treatment) (FIG. 22).

Example 13.6

Effect of 16H7 on Fasting and Fed Blood Glucose and Insulin Levels

Figure 23A:
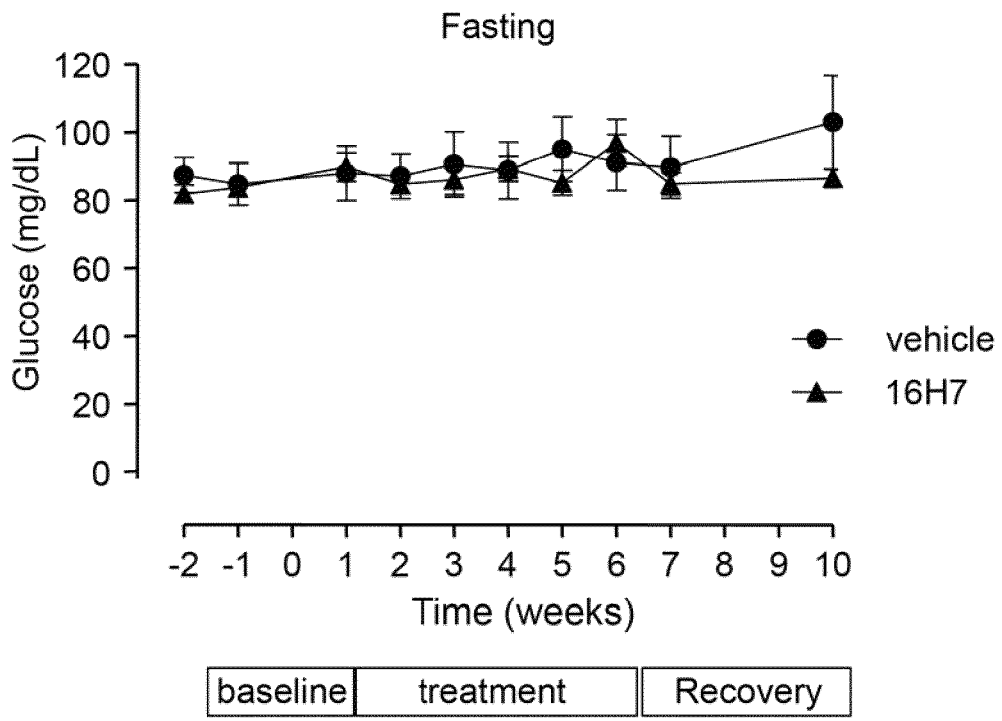
FIGS. 23A-23B are a plot showing the effects of vehicle and 16H7 on fasting plasma glucose levels of the obese cynomolgus monkeys studied.
Figure 23B:
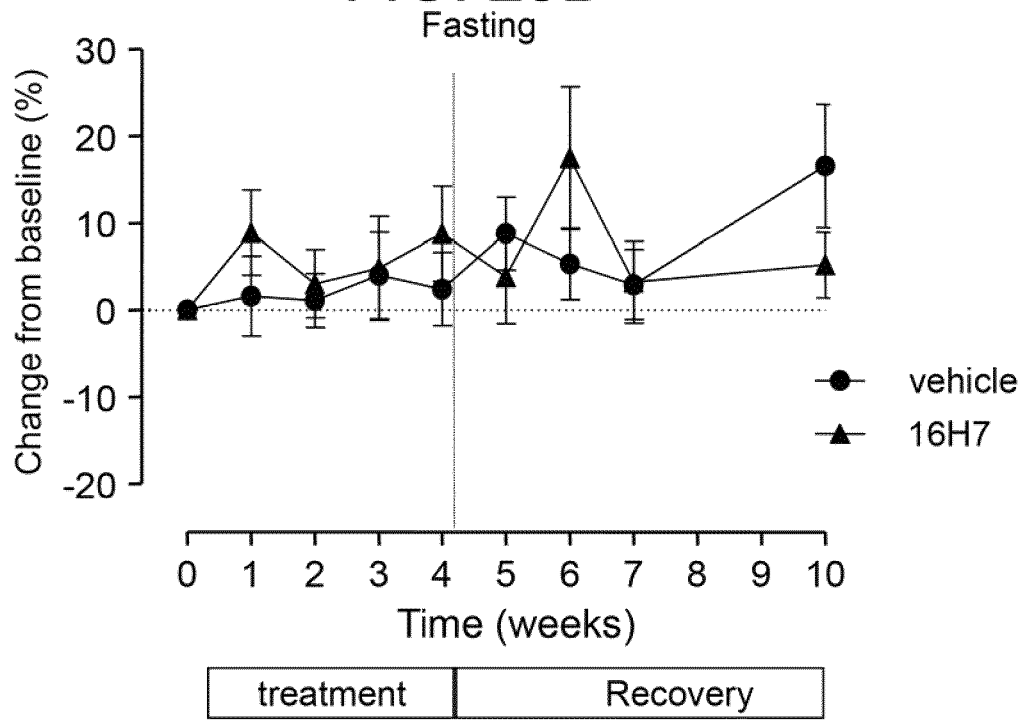
Figure 24A:
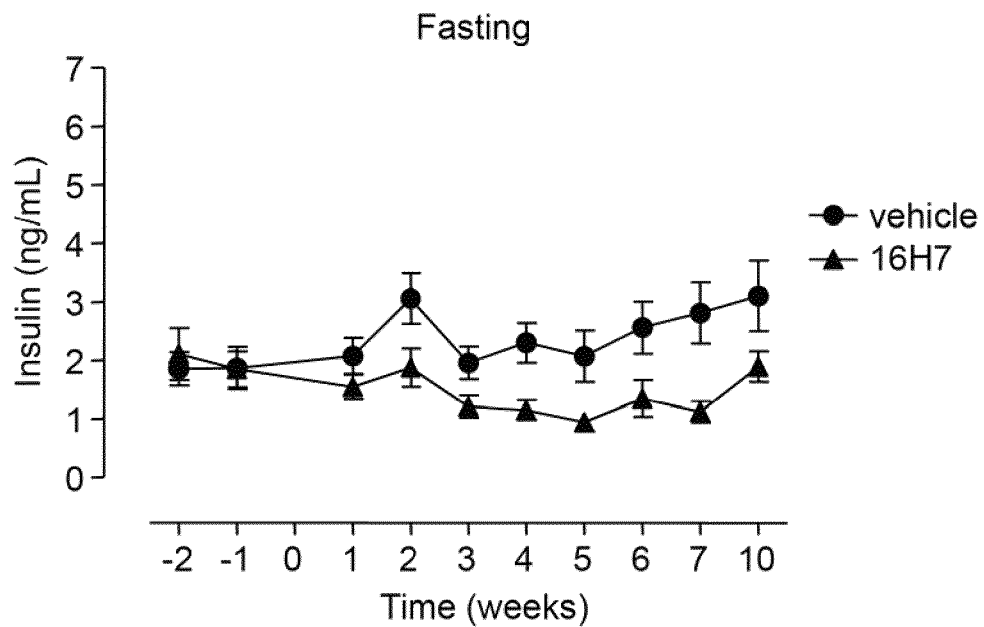
FIGS. 24A-24B are a plot showing the effects of vehicle and 16H7 on fasting plasma insulin levels of the obese cynomolgus monkeys studied.
Figure 24B:
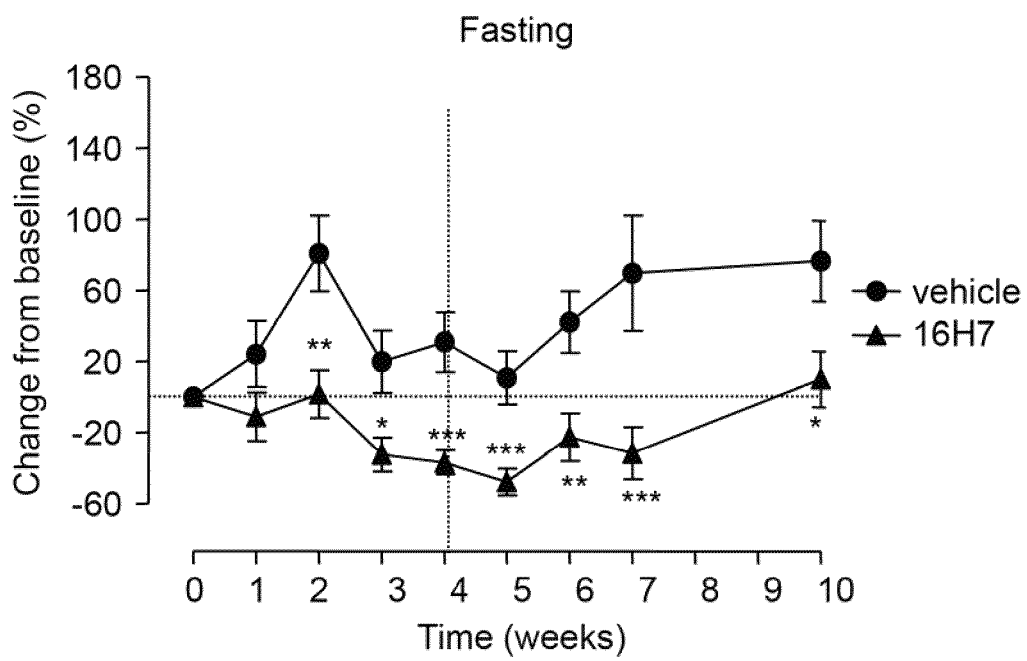
Figure 26A:
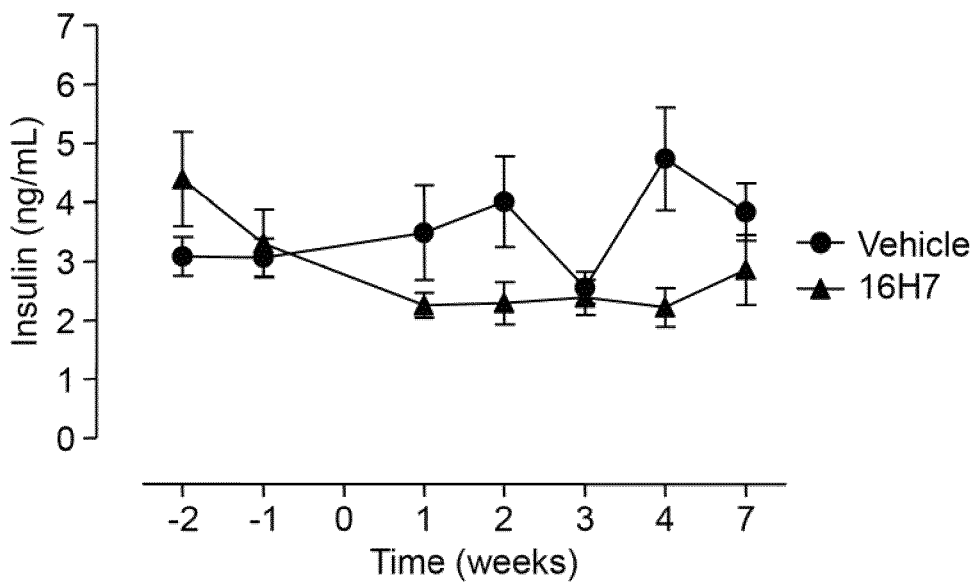
FIGS. 26A-26B are a plot showing the effects of vehicle and 16H7 on fed plasma insulin levels of the obese cynomolgus monkeys studied.
Figure 26B:
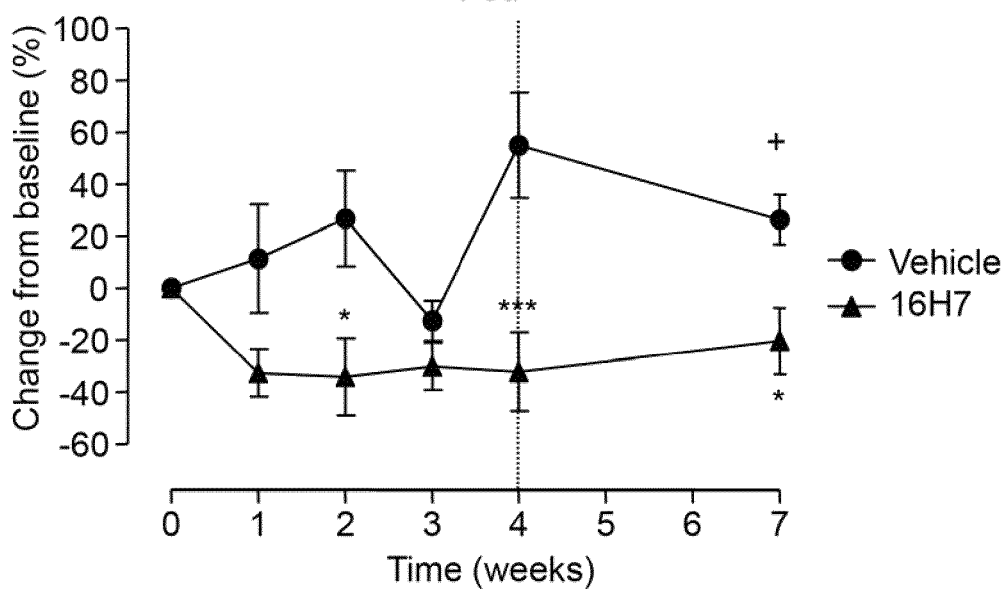

Blood was collected from overnight fasted animals or in fed conditions after the AM feeding. In the fasted conditions, blood drawn was conducted weekly 5 days post each injection. In the fed conditions, blood drawn was conducted on days 2, 11, 16, 25 and 46 post first injection. 16H7 did not reduce fasting or fed blood glucose levels (FIGS. 23 and 25). No hypoglycemia was observed in any of the monkeys treated with 16H7. 16H7 did, however, result in a statistically significant decrease in fasting and fed plasma insulin levels (FIGS. 24 and 26).

Example 13.7

Effect of 16H7 on Triglyceride Levels

Figure 27A:
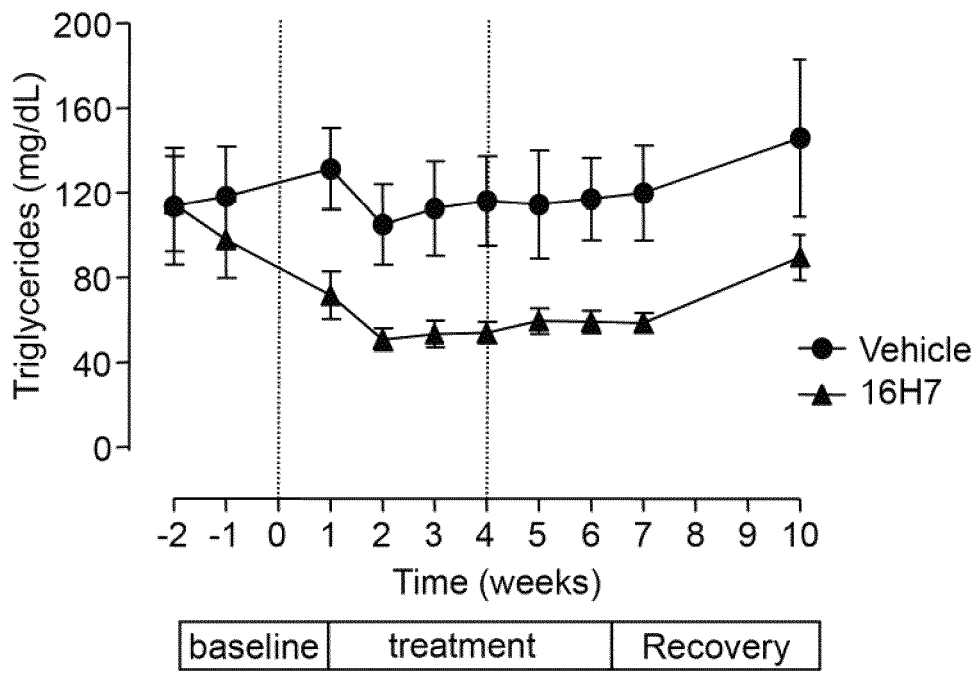
FIGS. 27A-27B are a plot showing the effects of vehicle and 16H7 on fasting plasma triglyceride levels of the obese cynomolgus monkeys studied.
Figure 27B:
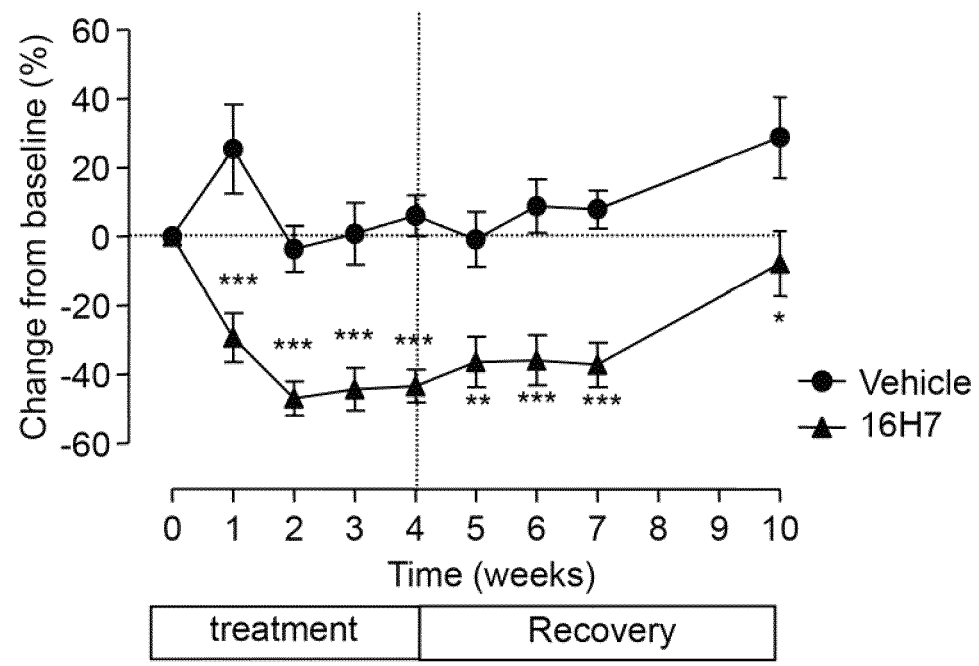
Figure 28A:
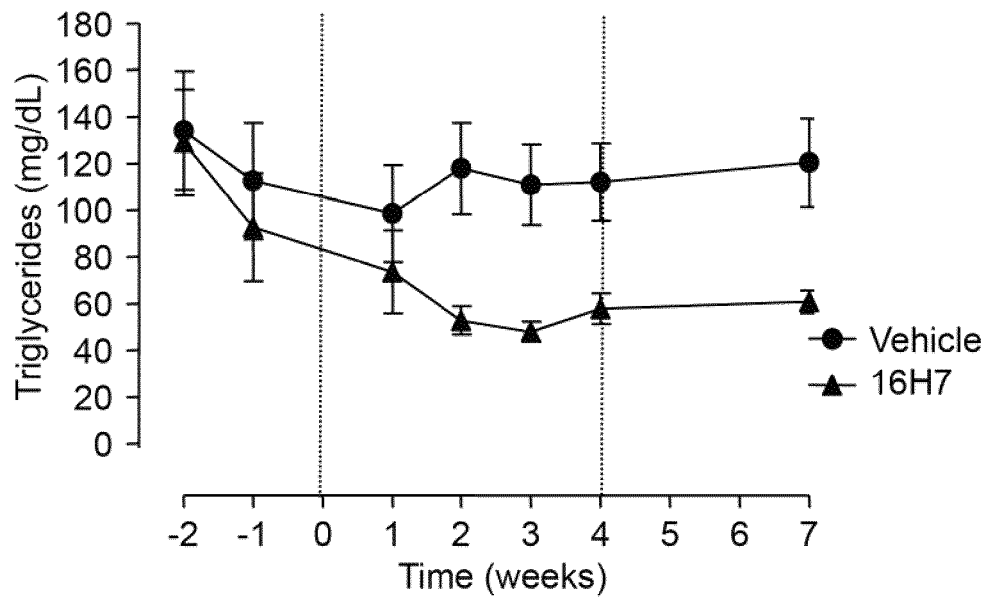
FIGS. 28A-28B are a plot showing the effects of vehicle and 16H7 on fed plasma triglyceride levels of the obese cynomolgus monkeys studied.
Figure 28B:
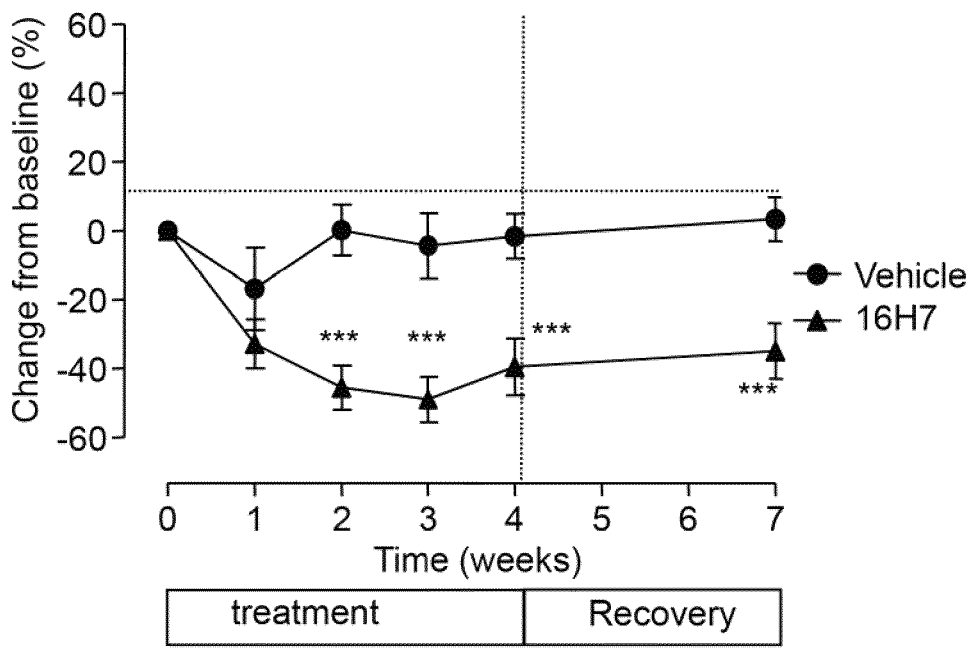

Measurements were made from the same samples collected for glucose and insulin measurements. Triglyceride levels were significantly reduced in animals treated with 16H7 when measured in fasted or fed conditions (FIGS. 27 and 28).

Example 13.8

Conclusions

In a study conducted in male obese cynomolgus monkeys, animals treated with 16H7 showed improved metabolic parameters. Body weight was reduced and body composition was improved. Short-term reduction of food intake was observed and the effect diminished and the food intake recovered to baseline or control levels at 21 days into the study. Fasting insulin and triglyceride levels were also reduced by 16H7. Insulin levels measured during OGTT were also improved.

Example 14

Variant Forms of Antigen Binding Proteins 16H7 and 22H5

Antigen binding proteins 16H7 and 22H5, which are described herein in Tables 1-4, were mutated to impart different properties to the molecule, such as changes in solubility, pI, overall charge, immunogenicity in humans and in animal models, stability, etc. The mutations comprised additions, deletions or substitutions in either the light chain (designated "LC", SEQ ID NO:14) or heavy chain (designated "HC", SEQ ID NO:32) of the molecule. The disclosed single point mutations were made individually or two or more mutations were combined.

Examples of mutations and combinations of mutations that were introduced into the 16H7 heavy and light chain sequences include the following:
  I83K (in 16H7 heavy chain) (SEQ ID NO:396)
  E16Q (in 16H7 heavy chain)+V24F (in 16H7 heavy chain)+I83T (in 16H7 heavy chain)+S100 I (in 16H7 heavy chain)+T119L (in 16H7 heavy chain) (SEQ ID NO:395)
  D109S (in 16H7 heavy chain) (SEQ ID NO:401)
  Deletion of Y107 (in 16H7 heavy chain) (SEQ ID NO:400)
  Insertion of a Y residue on the N-terminal side of Y107 (in 16H7 heavy chain) (SEQ ID NO:405)
  D88R+P89A+V90E (in 16H7 heavy chain) (SEQ ID NO:398)
  D49Y (in 16H7 light chain) (SEQ ID NO:386)
  D49A (in 16H7 light chain) (SEQ ID NO:387)
  D91A (in 16H7 light chain) (SEQ ID NO:388)
  D49A (in 16H7 light chain)+D91A (in 16H7 light chain) (SEQ ID NO:389)
  Q16K (in 16H7 light chain) (SEQ ID NO:385)

Examples of mutations and combinations of mutations that were introduced into the 22H5 heavy and light chain sequences include the following:
  N92Q (in 22H5 light chain) (SEQ ID NO:402)
  S94A (in 22H5 light chain) (SEQ ID NO:403)
  C109S (in 22H5 heavy chain) (SEQ ID NO:404)

Summarily, the generated antigen binding proteins comprised the following pairs of 16H7 heavy and light chains:
  (i) 16H7 light chain (SEQ ID NO:14) paired with a 16H7 heavy chain comprising I83K (SEQ ID NO:396);
  (ii) 16H7 light chain (SEQ ID NO:14) paired with a 16H7 heavy chain comprising E16Q, V24F, I83T, S100I, T119L (SEQ ID NO:395);
  (iii) 16H7 light chain (SEQ ID NO:14) paired with a 16H7 heavy chain comprising D109S (SEQ ID NO:401);
  (iv) 16H7 light chain (SEQ ID NO:14) paired with a 16H7 heavy chain comprising the deletion of Y107 (SEQ ID NO:400);
  (v) 16H7 light chain (SEQ ID NO:14) paired with a 16H7 heavy chain comprising the insertion of a Y residue on the N-terminal side of Y107 (SEQ ID NO:405);
  (vi) 16H7 light chain (SEQ ID NO:14) paired with a 16H7 heavy chain comprising D88R, P89A, V90E, (SEQ ID NO:398);
  (vii) 16H7 heavy chain (SEQ ID NO:32) paired with a 16H7 light chain comprising D49Y (SEQ ID NO:386);
  (viii) 16H7 heavy chain (SEQ ID NO:32) paired with a 16H7 light chain comprising D49A (LC) (SEQ ID NO:387);
  (xi) 16H7 heavy chain (SEQ ID NO:32) paired with a 16H7 light chain comprising D91A (SEQ ID NO:388);
  (ix) 16H7 heavy chain (SEQ ID NO:32) paired with a 16H7 light chain comprising D49A, D91A (SEQ ID NO:389);
  (x) 16H7 heavy chain (SEQ ID NO:32) paired with a 16H7 light chain comprising Q16K (LC) (SEQ ID NO:385);
and the following pairs of 22H5 heavy and light chain sequences:
  (xi) 22H5 heavy chain (SEQ ID NO:31) paired with a 22H5 light chain comprising N92Q (LC) (SEQ ID NO:402);
  (xii) 22H5 heavy chain (SEQ ID NO:31) paired with a 22H5 light chain comprising S94A (LC) (SEQ ID NO:403);
  (xiii) 22H5 light chain (SEQ ID NO:13) paired with a 22H5 heavy chain comprising C109S(HC) (SEQ ID NO:404);
  (xiv) 22H5 light chain (SEQ ID NO:13) paired with a 22H5 heavy chain comprising an insertion of a tyrosine residue at position 107 (SEQ ID NO:405).

The amino acid sequences for the generated light chain variants are shown in Table 6:

TABLE 6A

Amino Acid Sequences of 16H7 and 22H5 Variants

| Core Sequence | Variation | Paired With | SEQ ID NO of Paired Sequence | Amino Acid Sequence of Variant Chain | SEQ ID NO: |
|---|---|---|---|---|---|
| 16H7 light chain | Q16K | H3 | 32 | SYVLTQPPSVSVAPGKTARITCGGN NIGSESVHWYQQKPGQAPVLVVYD DSDRPSGIPERFSGSNSGNTATLTIS RVEAGDEADYYCQVWDGNSDHVV FGGGTKLTVLGQPKANPTVTLFPPS SEELQANKATLVCLISDFYPGAVTV AWKADGSPVKAGVETTKPSKQSN NKYAASSYLSLTPEQWKSHRSYSC QVTHEGSTVEKTVAPTECS | 385 |
| 16H7 light chain | D49Y | H3 | 32 | SYVLTQPPSVSVAPGQTARITCGGN NIGSESVHWYQQKPGQAPVLVVYY DSDRPSGIPERFSGSNSGNTATLTIS RVEAGDEADYYCQVWDGNSDHVV FGGGTKLTVLGQPKANPTVTLFPPS SEELQANKATLVCLISDFYPGAVTV AWKADGSPVKAGVETTKPSKQSN NKYAASSYLSLTPEQWKSHRSYSC QVTHEGSTVEKTVAPTECS | 386 |
| 16H7 light chain | D49A | H3 | 32 | SYVLTQPPSVSVAPGQTARITCGGN NIGSESVHWYQQKPGQAPVLVVYA DSDRPSGIPERFSGSNSGNTATLTIS RVEAGDEADYYCQVWDGNSDHVV FGGGTKLTVLGQPKANPTVTLFPPS SEELQANKATLVCLISDFYPGAVTV AWKADGSPVKAGVETTKPSKQSN NKYAASSYLSLTPEQWKSHRSYSC QVTHEGSTVEKTVAPTECS | 387 |
| 16H7 light chain | Q16K | H3 | 32 | SYVLTQPPSVSVAPGKTARITCGGN NIGSESVHWYQQKPGQAPVLVVYD DSDRPSGIPERFSGSNSGNTATLTIS RVEAGDEADYYCQVWDGNSDHVV FGGGTKLTVLGQPKANPTVTLFPPS SEELQANKATLVCLISDFYPGAVTV AWKADGSPVKAGVETTKPSKQSN NKYAASSYLSLTPEQWKSHRSYSC QVTHEGSTVEKTVAPTECS | 385 |
| 16H7 light chain | D49Y | H3 | 32 | SYVLTQPPSVSVAPGQTARITCGGN NIGSESVHWYQQKPGQAPVLVVYY DSDRPSGIPERFSGSNSGNTATLTIS RVEAGDEADYYCQVWDGNSDHVV FGGGTKLTVLGQPKANPTVTLFPPS SEELQANKATLVCLISDFYPGAVTV AWKADGSPVKAGVETTKPSKQSN NKYAASSYLSLTPEQWKSHRSYSC QVTHEGSTVEKTVAPTECS | 386 |
| 16H7 light chain | D91A | H3 | 32 | SYVLTQPPSVSVAPGQTARITCGGN NIGSESVHWYQQKPGQAPVLVVYD DSDRPSGIPERFSGSNSGNTATLTIS RVEAGDEADYYCQVWAGNSDHVV FGGGTKLTVLGQPKANPTVTLFPPS SEELQANKATLVCLISDFYPGAVTV AWKADGSPVKAGVETTKPSKQSN NKYAASSYLSLTPEQWKSHRSYSC QVTHEGSTVEKTVAPTECS | 388 |
| 16H7 light chain | Q16K | H3 | 32 | SYVLTQPPSVSVAPGKTARITCGGN NIGSESVHWYQQKPGQAPVLVVYD DSDRPSGIPERFSGSNSGNTATLTIS RVEAGDEADYYCQVWDGNSDHVV FGGGTKLTVLGQPKANPTVTLFPPS SEELQANKATLVCLISDFYPGAVTV AWKADGSPVKAGVETTKPSKQSN NKYAASSYLSLTPEQWKSHRSYSC QVTHEGSTVEKTVAPTECS | 385 |

TABLE 6A-continued

Amino Acid Sequences of 16H7 and 22H5 Variants

| Core Sequence | Variation | Paired With | SEQ ID NO of Paired Sequence | Amino Acid Sequence of Variant Chain | SEQ ID NO: |
|---|---|---|---|---|---|
| 16H7 light chain | D49Y | H3 | 32 | SYVLTQPPSVSVAPGQTARITCGGN NIGSESVHWYQQKPGQAPVLVVYY DSDRPSGIPERFSGSNSGNTATLTIS RVEAGDEADYYCQVWDGNSDHVV FGGGTKLTVLGQPKANPTVTLFPPS SEELQANKATLVCLISDFYPGAVTV AWKADGSPVKAGVETTKPSKQSN NKYAASSYLSLTPEQWKSHRSYSC QVTHEGSTVEKTVAPTECS | 386 |
| 16H7 light chain | D49A + D91A | H3 | 32 | SYVLTQPPSVSVAPGQTARITCGGN NIGSESVHWYQQKPGQAPVLVVYA DSDRPSGIPERFSGSNSGNTATLTIS RVEAGDEADYYCQVWAGNSDHVV FGGGTKLTVLGQPKANPTVTLFPPS SEELQANKATLVCLISDFYPGAVTV AWKADGSPVKAGVETTKPSKQSN NKYAASSYLSLTPEQWKSHRSYSC QVTHEGSTVEKTVAPTECS | 389 |
| 16H7 light chain | Q16K | H3 | 32 | SYVLTQPPSVSVAPGKTARITCGGN NIGSESVHWYQQKPGQAPVLVVYD DSDRPSGIPERFSGSNSGNTATLTIS RVEAGDEADYYCQVWDGNSDHVV FGGGTKLTVLGQPKANPTVTLFPPS SEELQANKATLVCLISDFYPGAVTV AWKADGSPVKAGVETTKPSKQSN NKYAASSYLSLTPEQWKSHRSYSC QVTHEGSTVEKTVAPTECS | 385 |
| 16H7 light chain | D49Y | H3 | 32 | SYVLTQPPSVSVAPGQTARITCGGN NIGSESVHWYQQKPGQAPVLVVYY DSDRPSGIPERFSGSNSGNTATLTIS RVEAGDEADYYCQVWDGNSDHVV FGGGTKLTVLGQPKANPTVTLFPPS SEELQANKATLVCLISDFYPGAVTV AWKADGSPVKAGVETTKPSKQSN NKYAASSYLSLTPEQWKSHRSYSC QVTHEGSTVEKTVAPTECS | 386 |
| 16H7 heavy chain | V24F | L3 | 14 | QVTLKESGPVLVKPTETLTLTCTFS GFSLNNARMGVSWIRQPPGKALEW LAHIFSNDEKSYSTSLKSRLTISKDT SKSQVVLIMTNMDPVDTATYYCAR SVVTGGYYYDGMDVWGQGTTVT VSSASTKGPSVFPLAPCSRSTSESTA ALGCLVKDYFPEPVTVSWNSGALT SGVHTFPAVLQSSGLYSLSSVVTVP SSNFGTQTYTCNVDHKPSNTKVDK TVERKCCVECPPCPAPPVAGPSVFL FPPKPKDTLMISRTPEVTCVVVDVS HEDPEVQFNWYVDGVEVHNAKTK PREEQFNSTFRVVSVLTVVHQDWL NGKEYKCKVSNKGLPAPIEKTISKT KGQPREPQVYTLPPSREEMTKNQV SLTCLVKGFYPSDIAVEWESNGQPE NNYKTTPPMLDSDGSFFLYSKLTV DKSRWQQGNVFSCSVMHEALHNH YTQKSLSLSPGK | 390 |
| 16H7 light chain | Q16K | H3 | 32 | SYVLTQPPSVSVAPGKTARITCGGN NIGSESVHWYQQKPGQAPVLVVYD DSDRPSGIPERFSGSNSGNTATLTIS RVEAGDEADYYCQVWDGNSDHVV FGGGTKLTVLGQPKANPTVTLFPPS SEELQANKATLVCLISDFYPGAVTV AWKADGSPVKAGVETTKPSKQSN NKYAASSYLSLTPEQWKSHRSYSC QVTHEGSTVEKTVAPTECS | 385 |
| 16H7 light chain | D49Y | H3 | 32 | SYVLTQPPSVSVAPGQTARITCGGN NIGSESVHWYQQKPGQAPVLVVYY DSDRPSGIPERFSGSNSGNTATLTIS | 386 |

TABLE 6A-continued

Amino Acid Sequences of 16H7 and 22H5 Variants

| Core Sequence | Variation | Paired With | SEQ ID NO of Paired Sequence | Amino Acid Sequence of Variant Chain | SEQ ID NO: |
|---|---|---|---|---|---|
| | | | | RVEAGDEADYYCQVW<u>D</u>GNSDHVV FGGGTKLTVLGQPKANPTVTLFPPS SEELQANKATLVCLISDFYPGAVTV AWKADGSPVKAGVETTKPSKQSN NKYAASSYLSLTPEQWKSHRSYSC QVTHEGSTVEKTVAPTECS | |
| 16H7 heavy chain | I83T | L3 | 14 | QVTLKESGPVLVKPT<u>E</u>TLTLTCT<u>V</u>S GFSLNNARMGVSWIRQPPGKALEW LAHIFSNDEKSYSTSLKSRLTISKDT SKSQVVL<u>T</u>MTNM<u>DPV</u>DTATYYCA R<u>S</u>VVTGGY<u>YY</u>DGMDVWGQGT<u>T</u>VT VSSASTKGPSVFPLAPCSRSTSESTA ALGCLVKDYFPEPVTVSWNSGALT SGVHTFPAVLQSSGLYSLSSVVTVP SSNFGTQTYTCNVDHKPSNTKVDK TVERKCCVECPPCPAPPVAGPSVFL FPPKPKDTLMISRTPEVTCVVVDVS HEDPEVQFNWYVDGVEVHNAKTK PREEQFNSTFRVVSVLTVVHQDWL NGKEYKCKVSNKGLPAPIEKTISKT KGQPREPQVYTLPPSREEMTKNQV SLTCLVKGFYPSDIAVEWESNGQPE NNYKTTPPMLDSDGSFFLYSKLTV DKSRWQQGNVFSCSVMHEALHNH YTQKSLSLSPGK | 391 |
| 16H7 light chain | Q16K | H3 | 32 | SYVLTQPPSVSVAPG<u>K</u>TARITCGGN NIGSESVHWYQQKPGQAPVLVVY<u>D</u> DSDRPSGIPERFSGSNSGNTATLTIS RVEAGDEADYYCQVW<u>D</u>GNSDHVV FGGGTKLTVLGQPKANPTVTLFPPS SEELQANKATLVCLISDFYPGAVTV AWKADGSPVKAGVETTKPSKQSN NKYAASSYLSLTPEQWKSHRSYSC QVTHEGSTVEKTVAPTECS | 385 |
| 16H7 light chain | D49Y | H3 | 32 | SYVLTQPPSVSVAPGQTARITCGGN NIGSESVHWYQQKPGQAPVLVVY<u>Y</u> DSDRPSGIPERFSGSNSGNTATLTIS RVEAGDEADYYCQVW<u>D</u>GNSDHVV FGGGTKLTVLGQPKANPTVTLFPPS SEELQANKATLVCLISDFYPGAVTV AWKADGSPVKAGVETTKPSKQSN NKYAASSYLSLTPEQWKSHRSYSC QVTHEGSTVEKTVAPTECS | 386 |
| 16H7 heavy chain | V24F + I83T | L3 | 14 | QVTLKESGPVLVKPT<u>E</u>TLTLTCT<u>F</u>S GFSLNNARMGVSWIRQPPGKALEW LAHIFSNDEKSYSTSLKSRLTISKDT SKSQVVL<u>T</u>MTNM<u>DPV</u>DTATYYCA R<u>S</u>VVTGGY<u>YY</u>DGMDVWGQGT<u>T</u>VT VSSASTKGPSVFPLAPCSRSTSESTA ALGCLVKDYFPEPVTVSWNSGALT SGVHTFPAVLQSSGLYSLSSVVTVP SSNFGTQTYTCNVDHKPSNTKVDK TVERKCCVECPPCPAPPVAGPSVFL FPPKPKDTLMISRTPEVTCVVVDVS HEDPEVQFNWYVDGVEVHNAKTK PREEQFNSTFRVVSVLTVVHQDWL NGKEYKCKVSNKGLPAPIEKTISKT KGQPREPQVYTLPPSREEMTKNQV SLTCLVKGFYPSDIAVEWESNGQPE NNYKTTPPMLDSDGSFFLYSKLTV DKSRWQQGNVFSCSVMHEALHNH YTQKSLSLSPGK | 392 |
| 16H7 light chain | Q16K | H3 | 32 | SYVLTQPPSVSVAPG<u>K</u>TARITCGGN NIGSESVHWYQQKPGQAPVLVVY<u>D</u> DSDRPSGIPERFSGSNSGNTATLTIS RVEAGDEADYYCQVW<u>D</u>GNSDHVV FGGGTKLTVLGQPKANPTVTLFPPS SEELQANKATLVCLISDFYPGAVTV | 385 |

TABLE 6A-continued

Amino Acid Sequences of 16H7 and 22H5 Variants

| Core Sequence | Variation | Paired With | SEQ ID NO of Paired Sequence | Amino Acid Sequence of Variant Chain | SEQ ID NO: |
|---|---|---|---|---|---|
| | | | | AWKADGSPVKAGVETTKPSKQSN NKYAASSYLSLTPEQWKSHRSYSC QVTHEGSTVEKTVAPTECS | |
| 16H7 light chain | D49Y | H3 | 32 | SYVLTQPPSVSVAPGQTARITCGGN NIGSESVHWYQQKPGQAPVLVVYY DSDRPSGIPERFSGSNSGNTATLTIS RVEAGDEADYYCQVWDGNSDHVV FGGGTKLTVLGQPKANPTVTLFPPS SEELQANKATLVCLISDFYPGAVTV AWKADGSPVKAGVETTKPSKQSN NKYAASSYLSLTPEQWKSHRSYSC QVTHEGSTVEKTVAPTECS | 386 |
| 16H7 heavy chain | E16Q + V24F + I83T | L3 | 14 | QVTLKESGPVLVKPTQTLTLTCTFS GFSLNNARMGVSWIRQPPGKALEW LAHIFSNDEKSYSTSLKSRLTISKDT SKSQVVLTMTNMDPVDTATYYCA RSVVTGGYYYDGMDVWGQGTTVT VSSASTKGPSVFPLAPCSRSTSESTA ALGCLVKDYFPEPVTVSWNSGALT SGVHTFPAVLQSSGLYSLSSVVTVP SSNFGTQTYTCNVDHKPSNTKVDK TVERKCCVECPPCPAPPVAGPSVFL FPPKPKDTLMISRTPEVTCVVVDVS HEDPEVQFNWYVDGVEVHNAKTK PREEQFNSTFRVVSVLTVVHQDWL NGKEYKCKVSNKGLPAPIEKTISKT KGQPREPQVYTLPPSREEMTKNQV SLTCLVKGFYPSDIAVEWESNGQPE NNYKTTPPMLDSDGSFFLYSKLTV DKSRWQQGNVFSCSVMHEALHNH YTQKSLSLSPGK | 393 |
| 16H7 light chain | Q16K | H3 | 32 | SYVLTQPPSVSVAPGKTARITCGGN NIGSESVHWYQQKPGQAPVLVVYD DSDRPSGIPERFSGSNSGNTATLTIS RVEAGDEADYYCQVWDGNSDHVV FGGGTKLTVLGQPKANPTVTLFPPS SEELQANKATLVCLISDFYPGAVTV AWKADGSPVKAGVETTKPSKQSN NKYAASSYLSLTPEQWKSHRSYSC QVTHEGSTVEKTVAPTECS | 385 |
| 16H7 light chain | D49Y | H3 | 32 | SYVLTQPPSVSVAPGQTARITCGGN NIGSESVHWYQQKPGQAPVLVVYY DSDRPSGIPERFSGSNSGNTATLTIS RVEAGDEADYYCQVWDGNSDHVV FGGGTKLTVLGQPKANPTVTLFPPS SEELQANKATLVCLISDFYPGAVTV AWKADGSPVKAGVETTKPSKQSN NKYAASSYLSLTPEQWKSHRSYSC QVTHEGSTVEKTVAPTECS | 386 |
| 16H7 heavy chain | E16Q + V24F + I83T + T119L | L3 | 14 | QVTLKESGPVLVKPTQTLTLTCTFS GFSLNNARMGVSWIRQPPGKALEW LAHIFSNDEKSYSTSLKSRLTISKDT SKSQVVLTMTNMDPVDTATYYCA RSVVTGGYYYDGMDVWGQGTLV TVSSASTKGPSVFPLAPCSRSTSEST AALGCLVKDYFPEPVTVSWNSGAL TSGVHTFPAVLQSSGLYSLSSVVTV PSSNFGTQTYTCNVDHKPSNTKVD KTVERKCCVECPPCPAPPVAGPSVF LFPPKPKDTLMISRTPEVTCVVVDV SHEDPEVQFNWYVDGVEVHNAKT KPREEQFNSTFRVVSVLTVVHQDW LNGKEYKCKVSNKGLPAPIEKTISK TKGQPREPQVYTLPPSREEMTKNQ VSLTCLVKGFYPSDIAVEWESNGQ ENNYKTTPPMLDSDGSFFLYSKLTV DKSRWQQGNVFSCSVMHEALHNH YTQKSLSLSPGK | 394 |

TABLE 6A-continued

Amino Acid Sequences of 16H7 and 22H5 Variants

| Core Sequence | Variation | Paired With | SEQ ID NO of Paired Sequence Chain | Amino Acid Sequence of Variant | SEQ ID NO: |
|---|---|---|---|---|---|
| 16H7 light chain | Q16K | H3 | 32 | SYVLTQPPSVSVAPGKTARITCGGN NIGSESVHWYQQKPGQAPVLVVYD DSDRPSGIPERFSGSNSGNTATLTIS RVEAGDEADYYCQVWDGNSDHVV FGGGTKLTVLGQPKANPTVTLFPPS SEELQANKATLVCLISDFYPGAVTV AWKADGSPVKAGVETTKPSKQSN NKYAASSYLSLTPEQWKSHRSYSC QVTHEGSTVEKTVAPTECS | 385 |
| 16H7 light chain | D49Y | H3 | 32 | SYVLTQPPSVSVAPGQTARITCGGN NIGSESVHWYQQKPGQAPVLVVYY DSDRPSGIPERFSGSNSGNTATLTIS RVEAGDEADYYCQVWDGNSDHVV FGGGTKLTVLGQPKANPTVTLFPPS SEELQANKATLVCLISDFYPGAVTV AWKADGSPVKAGVETTKPSKQSN NKYAASSYLSLTPEQWKSHRSYSC QVTHEGSTVEKTVAPTECS | 386 |
| 16H7 heavy chain | E16Q + V24F + I83T + S100I + T119L | L3 | 14 | QVTLKESGPVLVKPTQTLTLTCTFS GFSLNNARMGVSWIRQPPGKALEW LAHIFSNDEKSYSTSLKSRLTISKDT SKSQVVLTMTNMDPVDTATYYCA RIVVTGGYYYDGMDVWGQGTLVT VSSASTKGPSVFPLAPCSRSTSESTA ALGCLVKDYFPEPVTVSWNSGALT SGVHTFPAVLQSSGLYSLSSVVTVP SSNFGTQTYTCNVDHKPSNTKVDK TVERKCCVECPPCPAPPVAGPSVFL FPPKPKDTLMISRTPEVTCVVVDVS HEDPEVQFNWYVDGVEVHNAKTK PREEQFNSTFRVVSVLTVVHQDWL NGKEYKCKVSNKGLPAPIEKTISKT KGQPREPQVYTLPPSREEMTKNQV SLTCLVKGFYPSDIAVEWESNGQPE NNYKTTPPMLDSDGSFFLYSKLTV DKSRWQQGNVFSCSVMHEALHNH YTQKSLSLSPGK | 395 |
| 16H7 light chain | Q16K | H3 | 32 | SYVLTQPPSVSVAPGKTARITCGGN NIGSESVHWYQQKPGQAPVLVVYD DSDRPSGIPERFSGSNSGNTATLTIS RVEAGDEADYYCQVWDGNSDHVV FGGGTKLTVLGQPKANPTVTLFPPS SEELQANKATLVCLISDFYPGAVTV AWKADGSPVKAGVETTKPSKQSN NKYAASSYLSLTPEQWKSHRSYSC QVTHEGSTVEKTVAPTECS | 385 |
| 16H7 light chain | D49Y | H3 | 32 | SYVLTQPPSVSVAPGQTARITCGGN NIGSESVHWYQQKPGQAPVLVVYY DSDRPSGIPERFSGSNSGNTATLTIS RVEAGDEADYYCQVWDGNSDHVV FGGGTKLTVLGQPKANPTVTLFPPS SEELQANKATLVCLISDFYPGAVTV AWKADGSPVKAGVETTKPSKQSN NKYAASSYLSLTPEQWKSHRSYSC QVTHEGSTVEKTVAPTECS | 386 |
| 16H7 heavy chain | I83K | L3 | 14 | QVTLKESGPVLVKPTETLTLTCTVS GFSLNNARMGVSWIRQPPGKALEW LAHIFSNDEKSYSTSLKSRLTISKDT SKSQVVLKMTNMDPVDTATYYCA RSVVTGGYYYDGMDVWGQGTTVT VSSASTKGPSVFPLAPCSRSTSESTA ALGCLVKDYFPEPVTVSWNSGALT SGVHTFPAVLQSSGLYSLSSVVTVP SSNFGTQTYTCNVDHKPSNTKVDK TVERKCCVECPPCPAPPVAGPSVFL FPPKPKDTLMISRTPEVTCVVVDVS HEDPEVQFNWYVDGVEVHNAKTK | 396 |

TABLE 6A-continued

Amino Acid Sequences of 16H7 and 22H5 Variants

| Core Sequence | Variation | Paired With | SEQ ID NO of Paired Sequence | Amino Acid Sequence of Variant Chain | SEQ ID NO: |
|---|---|---|---|---|---|
| | | | | PREEQFNSTFRVVSVLTVVHQDWL NGKEYKCKVSNKGLPAPIEKTISKT KGQPREPQVYTLPPSREEMTKNQV SLTCLVKGFYPSDIAVEWESNGQPE NNYKTTPPMLDSDGSFFLYSKLTV DKSRWQQGNVFSCSVMHEALHNH YTQKSLSLSPGK | |
| 16H7 light chain | Q16K | H3 | 32 | SYVLTQPPSVSVAPGKTARITCGGN NIGSESVHWYQQKPGQAPVLVVYD DSDRPSGIPERFSGSNSGNTATLTIS RVEAGDEADYYCQVWDGNSDHVV FGGGTKLTVLGQPKANPTVTLFPPS SEELQANKATLVCLISDFYPGAVTV AWKADGSPVKAGVETTKPSKQSN NKYAASSYLSLTPEQWKSHRSYSC QVTHEGSTVEKTVAPTECS | 385 |
| 16H7 light chain | D49Y | H3 | 32 | SYVLTQPPSVSVAPGQTARITCGGN NIGSESVHWYQQKPGQAPVLVVYY DSDRPSGIPERFSGSNSGNTATLTIS RVEAGDEADYYCQVWDGNSDHVV FGGGTKLTVLGQPKANPTVTLFPPS SEELQANKATLVCLISDFYPGAVTV AWKADGSPVKAGVETTKPSKQSN NKYAASSYLSLTPEQWKSHRSYSC QVTHEGSTVEKTVAPTECS | 386 |
| 16H7 heavy chain | S100I | L3 | 14 | QVTLKESGPVLVKPTETLTLTCTVS GFSLNNARMGVSWIRQPPGKALEW LAHIFSNDEKSYSTSLKSRLTISKDT SKSQVVLIMTNMDPVDTATYYCAR IVVTGGYYYDGMDVWGQGTTVTV SSASTKGPSVFPLAPCSRSTSESTAA LGCLVKDYFPEPVTVSWNSGALTS GVHTFPAVLQSSGLYSLSSVVTVPS SNFGTQTYTCNVDHKPSNTKVDKT VERKCCVECPPCPAPPVAGPSVFLF PPKPKDTLMISRTPEVTCVVVDVSH EDPEVQFNWYVDGVEVHNAKTKP REEQFNSTFRVVSVLTVVHQDWLN GKEYKCKVSNKGLPAPIEKTISKTK GQPREPQVYTLPPSREEMTKNQVSL TCLVKGFYPSDIAVEWESNGQPEN NYKTTPPMLDSDGSFFLYSKLTVD KSRWQQGNVFSCSVMHEALHNHY TQKSLSLSPGK | 397 |
| 16H7 light chain | Q16K | H3 | 32 | SYVLTQPPSVSVAPGKTARITCGGN NIGSESVHWYQQKPGQAPVLVVYD DSDRPSGIPERFSGSNSGNTATLTIS RVEAGDEADYYCQVWDGNSDHVV FGGGTKLTVLGQPKANPTVTLFPPS SEELQANKATLVCLISDFYPGAVTV AWKADGSPVKAGVETTKPSKQSN NKYAASSYLSLTPEQWKSHRSYSC QVTHEGSTVEKTVAPTECS | 385 |
| 16H7 light chain | D49Y | H3 | 32 | SYVLTQPPSVSVAPGQTARITCGGN NIGSESVHWYQQKPGQAPVLVVYY DSDRPSGIPERFSGSNSGNTATLTIS RVEAGDEADYYCQVWDGNSDHVV FGGGTKLTVLGQPKANPTVTLFPPS SEELQANKATLVCLISDFYPGAVTV AWKADGSPVKAGVETTKPSKQSN NKYAASSYLSLTPEQWKSHRSYSC QVTHEGSTVEKTVAPTECS | 386 |
| 16H7 heavy chain | D88R + P89A + V90E | L3 | 14 | QVTLKESGPVLVKPTETLTLTCTVS GFSLNNARMGVSWIRQPPGKALEW LAHIFSNDEKSYSTSLKSRLTISKDT SKSQVVLIMTNMRAEDTATYYCAR SVVTGGYYYDGMDVWGQGTTVT | 398 |

TABLE 6A-continued

Amino Acid Sequences of 16H7 and 22H5 Variants

| Core Sequence | Variation | Paired With | SEQ ID NO of Paired Sequence | Amino Acid Sequence of Variant Chain | SEQ ID NO: |
|---|---|---|---|---|---|
| | | | | VSSASTKGPSVFPLAPCSRSTSESTA ALGCLVKDYFPEPVTVSWNSGALT SGVHTFPAVLQSSGLYSLSSVVTVP SSNFGTQTYTCNVDHKPSNTKVDK TVERKCCVECPPCPAPPVAGPSVFL FPPKPKDTLMISRTPEVTCVVVDVS HEDPEVQFNWYVDGVEVHNAKTK PREEQFNSTFRVVSVLTVVHQDWL NGKEYKCKVSNKGLPAPIEKTISKT KGQPREPQVYTLPPSREEMTKNQV SLTCLVKGFYPSDIAVEWESNGQPE NNYKTTPPMLDSDGSFFLYSKLTV DKSRWQQGNVFSCSVMHEALHNH YTQKSLSLSPGK | |
| 16H7 light chain | Q16K | H3 | 32 | SYVLTQPPSVSVAPGKTARITCGGN NIGSESVHWYQQKPGQAPVLVVYD DSDRPSGIPERFSGSNSGNTATLTIS RVEAGDEADYYCQVWDGNSDHVV FGGGTKLTVLGQPKANPTVTLFPPS SEELQANKATLVCLISDFYPGAVTV AWKADGSPVKAGVETTKPSKQSN NKYAASSYLSLTPEQWKSHRSYSC QVTHEGSTVEKTVAPTECS | 385 |
| 16H7 light chain | D49Y | H3 | 32 | SYVLTQPPSVSVAPGQTARITCGGN NIGSESVHWYQQKPGQAPVLVVYY DSDRPSGIPERFSGSNSGNTATLTIS RVEAGDEADYYCQVWDGNSDHVV FGGGTKLTVLGQPKANPTVTLFPPS SEELQANKATLVCLISDFYPGAVTV AWKADGSPVKAGVETTKPSKQSN NKYAASSYLSLTPEQWKSHRSYSC QVTHEGSTVEKTVAPTECS | 386 |
| 16H7 heavy chain | D88R + P89A + V90E + S100I | L3 | 14 | QVTLKESGPVLVKPTETLTLTCTVS GFSLNNARMGVSWIRQPPGKALEW LAHIFSNDEKSYSTSLKSRLTISKDT SKSQVVLIMTNMRAEDTATYYCAR IVVTGGYYYDGMDVWGQGTTVTV SSASTKGPSVFPLAPCSRSTSESTAA LGCLVKDYFPEPVTVSWNSGALTS GVHTFPAVLQSSGLYSLSSVVTVPS SNFGTQTYTCNVDHKPSNTKVDKT VERKCCVECPPCPAPPVAGPSVFLF PPKPKDTLMISRTPEVTCVVVDVSH EDPEVQFNWYVDGVEVHNAKTKP REEQFNSTFRVVSVLTVVHQDWLN GKEYKCKVSNKGLPAPIEKTISKTK GQPREPQVYTLPPSREEMTKNQVSL TCLVKGFYPSDIAVEWESNGQPEN NYKTTPPMLDSDGSFFLYSKLTVD KSRWQQGNVFSCSVMHEALHNHY TQKSLSLSPGK | 399 |
| 16H7 light chain | Q16K | H3 | 32 | SYVLTQPPSVSVAPGKTARITCGGN NIGSESVHWYQQKPGQAPVLVVYD DSDRPSGIPERFSGSNSGNTATLTIS RVEAGDEADYYCQVWDGNSDHVV FGGGTKLTVLGQPKANPTVTLFPPS SEELQANKATLVCLISDFYPGAVTV AWKADGSPVKAGVETTKPSKQSN NKYAASSYLSLTPEQWKSHRSYSC QVTHEGSTVEKTVAPTECS | 385 |
| 16H7 light chain | D49Y | H3 | 32 | SYVLTQPPSVSVAPGQTARITCGGN NIGSESVHWYQQKPGQAPVLVVYY DSDRPSGIPERFSGSNSGNTATLTIS RVEAGDEADYYCQVWDGNSDHVV FGGGTKLTVLGQPKANPTVTLFPPS SEELQANKATLVCLISDFYPGAVTV | 386 |

TABLE 6A-continued

Amino Acid Sequences of 16H7 and 22H5 Variants

| Core Sequence | Variation | Paired With | SEQ ID NO of Paired Sequence | Amino Acid Sequence of Variant Chain | SEQ ID NO: |
|---|---|---|---|---|---|
| | | | | AWKADGSPVKAGVETTKPSKQSN NKYAASSYLSLTPEQWKSHRSYSC QVTHEGSTVEKTVAPTECS | |
| 16H7 heavy chain | Deletion of Y107 | L3 | 14 | QVTLKESGPVLVKPTETLTLTCTVS GFSLNNARMGVSWIRQPPGKALEW LAHIFSNDEKSYSTSLKSRLTISKDT SKSQVVLIMTNMDPVDTATYYCAR SVVTGGYYDGMDVWGQGTTVTVS SASTKGPSVFPLAPCSRSTSESTAAL GCLVKDYFPEPVTVSWNSGALTSG VHTFPAVLQSSGLYSLSSVVTVPSS NFGTQTYTCNVDHKPSNTKVDKTV ERKCCVECPPCPAPPVAGPSVFLFPP KPKDTLMISRTPEVTCVVVDVSHE DPEVQFNWYVDGVEVHNAKTKPR EEQFNSTFRVVSVLTVVHQDWLNG KEYKCKVSNKGLPAPIEKTISKTKG QPREPQVYTLPPSREEMTKNQVSLT CLVKGFYPSDIAVEWESNGQPENN YKTTPPMLDSDGSFFLYSKLTVDKS RWQQGNVFSCSVMHEALHNHYTQ KSLSLSPGK | 400 |
| 16H7 light chain | Q16K | H3 | 32 | SYVLTQPPSVSVAPGKTARITCGGN NIGSESVHWYQQKPGQAPVLVVYD DSDRPSGIPERFSGSNSGNTATLTIS RVEAGDEADYYCQVWDGNSDHVV FGGGTKLTVLGQPKANPTVTLFPPS SEELQANKATLVCLISDFYPGAVTV AWKADGSPVKAGVETTKPSKQSN NKYAASSYLSLTPEQWKSHRSYSC QVTHEGSTVEKTVAPTECS | 385 |
| 16H7 light chain | D49Y | H3 | 32 | SYVLTQPPSVSVAPGQTARITCGGN NIGSESVHWYQQKPGQAPVLVVYY DSDRPSGIPERFSGSNSGNTATLTIS RVEAGDEADYYCQVWDGNSDHVV FGGGTKLTVLGQPKANPTVTLFPPS SEELQANKATLVCLISDFYPGAVTV AWKADGSPVKAGVETTKPSKQSN NKYAASSYLSLTPEQWKSHRSYSC QVTHEGSTVEKTVAPTECS | 386 |
| 16H7 heavy chain | D109S | L3 | 14 | QVTLKESGPVLVKPTETLTLTCTVS GFSLNNARMGVSWIRQPPGKALEW LAHIFSNDEKSYSTSLKSRLTISKDT SKSQVVLIMTNMDPVDTATYYCAR SVVTGGYYYSGMDVWGQGTTVTV SSASTKGPSVFPLAPCSRSTSESTAA LGCLVKDYFPEPVTVSWNSGALTS GVHTFPAVLQSSGLYSLSSVVTVPS SNFGTQTYTCNVDHKPSNTKVDKT VERKCCVECPPCPAPPVAGPSVFLF PPKPKDTLMISRTPEVTCVVVDVSH EDPEVQFNWYVDGVEVHNAKTKP REEQFNSTFRVVSVLTVVHQDWLN GKEYKCKVSNKGLPAPIEKTISKTK GQPREPQVYTLPPSREEMTKNQVSL TCLVKGFYPSDIAVEWESNGQPEN NYKTTPPMLDSDGSFFLYSKLTVD KSRWQQGNVFSCSVMHEALHNHY TQKSLSLSPGK | 401 |
| 16H7 light chain | Q16K | H3 | 32 | SYVLTQPPSVSVAPGKTARITCGGN NIGSESVHWYQQKPGQAPVLVVYD DSDRPSGIPERFSGSNSGNTATLTIS RVEAGDEADYYCQVWDGNSDHVV FGGGTKLTVLGQPKANPTVTLFPPS SEELQANKATLVCLISDFYPGAVTV AWKADGSPVKAGVETTKPSKQSN NKYAASSYLSLTPEQWKSHRSYSC QVTHEGSTVEKTVAPTECS | 385 |

TABLE 6A-continued

Amino Acid Sequences of 16H7 and 22H5 Variants

| Core Sequence | Variation | Paired With | SEQ ID NO of Paired Sequence Chain | Amino Acid Sequence of Variant | SEQ ID NO: |
|---|---|---|---|---|---|
| 16H7 light chain | D49Y | H3 | 32 | SYVLTQPPSVSVAPGQTARITCGGN NIGSESVHWYQQKPGQAPVLVVYY DSDRPSGIPERFSGSNSGNTATLTIS RVEAGDEADYYCQVWDGNSDHVV FGGGTKLTVLGQPKANPTVTLFPPS SEELQANKATLVCLISDFYPGAVTV AWKADGSPVKAGVETTKPSKQSN NKYAASSYLSLTPEQWKSHRSYSC QVTHEGSTVEKTVAPTECS | 386 |
| 22H5 light chain | N92Q | H2 | 31 | SYVLTQPPSVSVAPGQTARITCGGN NIGSQSVHWYQQKPGQAPVLVVY DDSDRPSGIPERFSGSNSGNTATLTI SRVEAGDEADYYCQVWDQTSDHV VFGGGTKLTVLGQPKANPTVTLFPP SSEELQANKATLVCLISDFYPGAVT VAWKADGSPVKAGVETTKPSKQS NNKYAASSYLSLTPEQWKSHRSYS CQVTHEGSTVEKTVAPTECS | 402 |
| 16H7 light chain | Q16K | H3 | 32 | SYVLTQPPSVSVAPGKTARITCGGN NIGSESVHWYQQKPGQAPVLVVYD DSDRPSGIPERFSGSNSGNTATLTIS RVEAGDEADYYCQVWDGNSDHVV FGGGTKLTVLGQPKANPTVTLFPPS SEELQANKATLVCLISDFYPGAVTV AWKADGSPVKAGVETTKPSKQSN NKYAASSYLSLTPEQWKSHRSYSC QVTHEGSTVEKTVAPTECS | 385 |
| 16H7 light chain | D49Y | H3 | 32 | SYVLTQPPSVSVAPGQTARITCGGN NIGSESVHWYQQKPGQAPVLVVYY DSDRPSGIPERFSGSNSGNTATLTIS RVEAGDEADYYCQVWDGNSDHVV FGGGTKLTVLGQPKANPTVTLFPPS SEELQANKATLVCLISDFYPGAVTV AWKADGSPVKAGVETTKPSKQSN NKYAASSYLSLTPEQWKSHRSYSC QVTHEGSTVEKTVAPTECS | 386 |
| 22H5 light chain | S94A | H2 | 31 | SYVLTQPPSVSVAPGQTARITCGGN NIGSQSVHWYQQKPGQAPVLVVY DDSDRPSGIPERFSGSNSGNTATLTI SRVEAGDEADYYCQVWDNTADHV VFGGGTKLTVLGQPKANPTVTLFPP SSEELQANKATLVCLISDFYPGAVT VAWKADGSPVKAGVETTKPSKQS NNKYAASSYLSLTPEQWKSHRSYS CQVTHEGSTVEKTVAPTECS | 403 |
| 16H7 light chain | Q16K | H3 | 32 | SYVLTQPPSVSVAPGKTARITCGGN NIGSESVHWYQQKPGQAPVLVVYD DSDRPSGIPERFSGSNSGNTATLTIS RVEAGDEADYYCQVWDGNSDHVV FGGGTKLTVLGQPKANPTVTLFPPS SEELQANKATLVCLISDFYPGAVTV AWKADGSPVKAGVETTKPSKQSN NKYAASSYLSLTPEQWKSHRSYSC QVTHEGSTVEKTVAPTECS | 385 |
| 16H7 light chain | D49Y | H3 | 32 | SYVLTQPPSVSVAPGQTARITCGGN NIGSESVHWYQQKPGQAPVLVVYY DSDRPSGIPERFSGSNSGNTATLTIS RVEAGDEADYYCQVWDGNSDHVV FGGGTKLTVLGQPKANPTVTLFPPS SEELQANKATLVCLISDFYPGAVTV AWKADGSPVKAGVETTKPSKQSN NKYAASSYLSLTPEQWKSHRSYSC QVTHEGSTVEKTVAPTECS | 386 |

TABLE 6A-continued

Amino Acid Sequences of 16H7 and 22H5 Variants

| Core Sequence | Variation | Paired With | SEQ ID NO of Paired Sequence | Amino Acid Sequence of Variant Chain | SEQ ID NO: |
|---|---|---|---|---|---|
| 22H5 heavy chain | C109S | L2 | 13 | QVTLKESGPVLVKPTETLTLTCTVS GFSLSNARMGVSWIRQPPGKALEW LAHIFSNDEKSYSTSLKSRLTISKDT SKSQVVLTMTNMDPVDTATYYCA RILLVGAYYYSGMDVWGQGTTVT VSSASTKGPSVFPLAPCSRSTSESTA ALGCLVKDYFPEPVTVSWNSGALT SGVHTFPAVLQSSGLYSLSSVVTVP SSNFGTQTYTCNVDHKPSNTKVDK TVERKCCVECPPCPAPPVAGPSVFL FPPKPKDTLMISRTPEVTCVVVDVS HEDPEVQFNWYVDGVEVHNAKTK PREEQFNSTFRVVSVLTVVHQDWL NGKEYKCKVSNKGLPAPIEKTISKT KGQPREPQVYTLPPSREEMTKNQV SLTCLVKGFYPSDIAVEWESNGQPE NNYKTTPPMLDSDGSFFLYSKLTV DKSRWQQGNVFSCSVMHEALHNH YTQKSLSLSPGK | 404 |
| 16H7 light chain | Q16K | H3 | 32 | SYVLTQPPSVSVAPGKTARITCGGN NIGSESVHWYQQKPGQAPVLVVYD DSDRPSGIPERFSGSNSGNTATLTIS RVEAGDEADYYCQVWDGNSDHVV FGGGTKLTVLGQPKANPTVTLFPPS SEELQANKATLVCLISDFYPGAVTV AWKADGSPVKAGVETTKPSKQSN NKYAASSYLSLTPEQWKSHRSYSC QVTHEGSTVEKTVAPTECS | 385 |
| 16H7 light chain | D49Y | H3 | 32 | SYVLTQPPSVSVAPGQTARITCGGN NIGSESVHWYQQKPGQAPVLVVYY DSDRPSGIPERFSGSNSGNTATLTIS RVEAGDEADYYCQVWDGNSDHVV FGGGTKLTVLGQPKANPTVTLFPPS SEELQANKATLVCLISDFYPGAVTV AWKADGSPVKAGVETTKPSKQSN NKYAASSYLSLTPEQWKSHRSYSC QVTHEGSTVEKTVAPTECS | 386 |
| 16H7 heavy chain | Insertion of Y107 | L3 | 14 | QVTLKESGPVLVKPTETLTLTCTVS GFSLNNARMGVSWIRQPPGKALEW LAHIFSNDEKSYSTSLKSRLTISKDT SKSQVVLIMTNMDPVDTATYYCAR SVVTGGYYYYDGMDVWGQGTTV TVSSASTKGPSVFPLAPCSRSTSEST AALGCLVKDYFPEPVTVSWNSGAL TSGVHTFPAVLQSSGLYSLSSVVTV PSSNFGTQTYTCNVDHKPSNTKVD KTVERKCCVECPPCPAPPVAGPSVF LFPPKPKDTLMISRTPEVTCVVVDV SHEDPEVQFNWYVDGVEVHNAKT KPREEQFNSTFRVVSVLTVVHQDW LNGKEYKCKVSNKGLPAPIEKTISK TKGQPREPQVYTLPPSREEMTKNQ VSLTCLVKGFYPSDIAVEWESNGQP ENNYKTTPPMLDSDGSFFLYSKLTV DKSRWQQGNVFSCSVMHEALHNH YTQKSLSLSPGK | 405 |

TABLE 6B

Nucleic Acid Sequences of 16H7 and 22H5 Variants

| Core Sequence | Variation | Nucleic Acid Sequence | SEQ ID NO: |
|---|---|---|---|
| 16H7 light chain | Q16K | TCCTATGTGCTGACTCAGCCACCCTCGGTGT CAGTGGCCCCAGGAAAGACGGCCAGGATT ACCTGTGGGGGAAACAACATTGGAAGTGA AAGTGTGCACTGGTACCAGCAGAAGCCAGG CCAGGCCCCTGTGCTGGTCGTCTAT<u>GAT</u>GA TAGCGACCGGCCCTCAGGGATCCCTGAGCG ATTCTCTGGCTCCAACTCTGGGAACACGGC CACCCTGACCATCAGCAGGGTCGAAGCCGG GGATGAGGCCGACTATTACTGTCAGGTGTG G<u>GAT</u>GGTAATAGTGACCATGTGGTATTCGG CGGAGGGACCAAGCTGACCGTCCTAGGTCA GCCCAAGGCCAACCCCACTGTCACTCTGTT CCCGCCCTCCTCTGAGGAGCTCCAAGCCAA CAAGGCCACACTAGTGTGTCTGATCAGTGA CTTCTACCCGGGAGCTGTGACAGTGGCCTG GAAGGCAGATGGCAGCCCCGTCAAGGCGG GAGTGGAGACCACCAAACCCTCCAAACAG AGCAACAACAAGTACGCGGCCAGCAGCTA CCTGAGCCTGACGCCCGAGCAGTGGAAGTC CCACAGAAGCTACAGCTGCCAGGTCACGCA TGAAGGGAGCACCGTGGAGAAGACAGTGG CCCCTACAGAATGTTCA | 406 |
| 16H7 light chain | D49Y | TCCTATGTGCTGACTCAGCCACCCTCGGTGT CAGTGGCCCCAGGA<u>CAG</u>ACGGCCAGGATTA CCTGTGGGGGAAACAACATTGGAAGTGAA AGTGTGCACTGGTACCAGCAGAAGCCAGGC CAGGCCCCTGTGCTGGTCGTCTATTATGAT AGCGACCGGCCCTCAGGGATCCCTGAGCGA TTCTCTGGCTCCAACTCTGGGAACACGGCC ACCCTGACCATCAGCAGGGTCGAAGCCGGG GATGAGGCCGACTATTACTGTCAGGTGTGG <u>GAT</u>GGTAATAGTGACCATGTGGTATTCGGC GGAGGGACCAAGCTGACCGTCCTAGGTCAG CCCAAGGCCAACCCCACTGTCACTCTGTTC CCGCCCTCCTCTGAGGAGCTCCAAGCCAAC AAGGCCACACTAGTGTGTCTGATCAGTGAC TTCTACCCGGGAGCTGTGACAGTGGCCTGG AAGGCAGATGGCAGCCCCGTCAAGGCGGG AGTGGAGACCACCAAACCCTCCAAACAGA GCAACAACAAGTACGCGGCCAGCAGCTACC TGAGCCTGACGCCCGAGCAGTGGAAGTCCC ACAGAAGCTACAGCTGCCAGGTCACGCATG AAGGGAGCACCGTGGAGAAGACAGTGGCC CCTACAGAATGTTCA | 407 |
| 16H7 light chain | D49A | TCCTATGTGCTGACTCAGCCACCCTCGGTGT CAGTGGCCCCAGGA<u>CAG</u>ACGGCCAGGATTA CCTGTGGGGGAAACAACATTGGAAGTGAA AGTGTGCACTGGTACCAGCAGAAGCCAGGC CAGGCCCCTGTGCTGGTCGTCTATGCTGAT AGCGACCGGCCCTCAGGGATCCCTGAGCGA TTCTCTGGCTCCAACTCTGGGAACACGGCC ACCCTGACCATCAGCAGGGTCGAAGCCGGG GATGAGGCCGACTATTACTGTCAGGTGTGG <u>GAT</u>GGTAATAGTGACCATGTGGTATTCGGC GGAGGGACCAAGCTGACCGTCCTAGGTCAG CCCAAGGCCAACCCCACTGTCACTCTGTTC CCGCCCTCCTCTGAGGAGCTCCAAGCCAAC AAGGCCACACTAGTGTGTCTGATCAGTGAC TTCTACCCGGGAGCTGTGACAGTGGCCTGG AAGGCAGATGGCAGCCCCGTCAAGGCGGG AGTGGAGACCACCAAACCCTCCAAACAGA GCAACAACAAGTACGCGGCCAGCAGCTACC TGAGCCTGACGCCCGAGCAGTGGAAGTCCC ACAGAAGCTACAGCTGCCAGGTCACGCATG AAGGGAGCACCGTGGAGAAGACAGTGGCC CCTACAGAATGTTCA | 408 |
| 16H7 light chain | D91A | TCCTATGTGCTGACTCAGCCACCCTCGGTGT CAGTGGCCCCAGGA<u>CAG</u>ACGGCCAGGATTA CCTGTGGGGGAAACAACATTGGAAGTGAA AGTGTGCACTGGTACCAGCAGAAGCCAGGC CAGGCCCCTGTGCTGGTCGTCTAT<u>GAT</u>GAT AGCGACCGGCCCTCAGGGATCCCTGAGCGA | 409 |

TABLE 6B-continued

Nucleic Acid Sequences of 16H7 and 22H5 Variants

| Core Sequence | Variation | Nucleic Acid Sequence | SEQ ID NO: |
|---|---|---|---|
| | | TTCTCTGGCTCCAACTCTGGGAACACGGCC<br>ACCCTGACCATCAGCAGGGTCGAAGCCGGG<br>GATGAGGCCGACTATTACTGTCAGGTGTGG<br>GCTGGTAATAGTGACCATGTGGTATTCGGC<br>GGAGGGACCAAGCTGACCGTCCTAGGTCAG<br>CCCAAGGCCAACCCCACTGTCACTCTGTTC<br>CCGCCCTCCTCTGAGGAGCTCCAAGCCAAC<br>AAGGCCACACTAGTGTGTCTGATCAGTGAC<br>TTCTACCCGGGAGCTGTGACAGTGGCCTGG<br>AAGGCAGATGGCAGCCCCGTCAAGGCGGG<br>AGTGGAGACCACCAAACCCTCCAAACAGA<br>GCAACAACAAGTACGCGGCCAGCAGCTACC<br>TGAGCCTGACGCCCGAGCAGTGGAAGTCCC<br>ACAGAAGCTACAGCTGCCAGGTCACGCATG<br>AAGGGAGCACCGTGGAGAAGACAGTGGCC<br>CCTACAGAATGTTCA | |
| 16H7 light chain | D49A + D91A | TCCTATGTGCTGACTCAGCCACCCTCGGTGT<br>CAGTGGCCCCAGGACAGACGGCCAGGATTA<br>CCTGTGGGGGAAACAACATTGGAAGTGAA<br>AGTGTGCACTGGTACCAGCAGAAGCCAGGC<br>CAGGCCCCTGTGCTGGTCGTCTATGCTGAT<br>AGCGACCGGCCCTCAGGGATCCCTGAGCGA<br>TTCTCTGGCTCCAACTCTGGGAACACGGCC<br>ACCCTGACCATCAGCAGGGTCGAAGCCGGG<br>GATGAGGCCGACTATTACTGTCAGGTGTGG<br>GCTGGTAATAGTGACCATGTGGTATTCGGC<br>GGAGGGACCAAGCTGACCGTCCTAGGTCAG<br>CCCAAGGCCAACCCCACTGTCACTCTGTTC<br>CCGCCCTCCTCTGAGGAGCTCCAAGCCAAC<br>AAGGCCACACTAGTGTGTCTGATCAGTGAC<br>TTCTACCCGGGAGCTGTGACAGTGGCCTGG<br>AAGGCAGATGGCAGCCCCGTCAAGGCGGG<br>AGTGGAGACCACCAAACCCTCCAAACAGA<br>GCAACAACAAGTACGCGGCCAGCAGCTACC<br>TGAGCCTGACGCCCGAGCAGTGGAAGTCCC<br>ACAGAAGCTACAGCTGCCAGGTCACGCATG<br>AAGGGAGCACCGTGGAGAAGACAGTGGCC<br>CCTACAGAATGTTCA | 410 |
| 16H7 heavy chain | V24F | CAGGTCACCTTGAAGGAGTCTGGTCCTGTG<br>CTGGTGAAACCCACAGAGACCCTCACGCTG<br>ACCTGCACCTTCTCTGGGTTCTCACTCAACA<br>ATGCTAGAATGGGTGTGAGCTGGATCCGTC<br>AGCCCCCAGGGAAGGCCCTGGAGTGGCTTG<br>CACACATTTTTTCGAATGACGAAAAATCCT<br>ACAGCACATCTCTGAAGAGCAGGCTCACCA<br>TCTCCAAGGACACCTCCAAAAGCCAGGTGG<br>TCCTAATTATGACCAACATGGACCCTGTGG<br>ACACAGCCACATATTACTGTGCACGGTCAG<br>TAGTAACTGGCGGCTACTACTACGACGGTA<br>TGGACGTCTGGGGCCAAGGGACCACGGTCA<br>CCGTCTCTAGTGCCTCCACCAAGGGCCCAT<br>CGGTCTTCCCCCTGGCGCCCTGCTCCAGGA<br>GCACCTCCGAGAGCACAGCGGCCCTGGGCT<br>GCCTGGTCAAGGACTACTTCCCCGAACCGG<br>TGACGGTGTCGTGGAACTCAGGCGCTCTGA<br>CCAGCGGCGTGCACACCTTCCCAGCTGTCC<br>TACAGTCCTCAGGACTCTACTCCCTCAGCA<br>GCGTGGTGACCGTGCCCTCCAGCAACTTCG<br>GCACCCAGACCTACACCTGCAACGTAGATC<br>ACAAGCCCAGCAACACCAAGGTGGACAAG<br>ACAGTTGAGCGCAAATGTTGTGTCGAGTGC<br>CCACCGTGCCCAGCACCACCTGTGGCAGGA<br>CCGTCAGTCTTCCTCTTCCCCCCAAAACCCA<br>AGGACACCCTCATGATCTCCCGGACCCCTG<br>AGGTCACGTGCGTGGTGGTGGACGTGAGCC<br>ACGAAGACCCCGAGGTCCAGTTCAACTGGT<br>ACGTGGACGGCGTGGAGGTGCATAATGCCA<br>AGACAAAGCCACGGGAGGAGCAGTTCAAC<br>AGCACGTTCCGTGTGGTCAGCGTCCTCACC<br>GTTGTGCACCAGGACTGGCTGAACGGCAAG<br>GAGTACAAGTGCAAGGTCTCCAACAAAGGC<br>CTCCCAGCCCCCATCGAGAAAACCATCTCC<br>AAAACCAAAGGGCAGCCCCGAGAACCACA | 411 |

TABLE 6B-continued

Nucleic Acid Sequences of 16H7 and 22H5 Variants

| Core Sequence | Variation | Nucleic Acid Sequence | SEQ ID NO: |
|---|---|---|---|
| | | GGTGTACACCCTGCCCCCATCCCGGGAGGA<br>GATGACCAAGAACCAGGTCAGCCTGACCTG<br>CCTGGTCAAAGGCTTCTACCCCAGCGACAT<br>CGCCGTGGAGTGGGAGAGCAATGGGCAGC<br>CGGAGAACAACTACAAGACCACACCTCCCA<br>TGCTGGACTCCGACGGCTCCTTCTTCCTCTA<br>CAGCAAGCTCACCGTGGACAAGAGCAGGT<br>GGCAGCAGGGGAACGTCTTCTCATGCTCCG<br>TGATGCATGAGGCTCTGCACAACCACTACA<br>CGCAGAAGAGCCTCTCCCTGTCTCCGGGTA<br>AA | |
| 16H7 heavy chain | I83T | CAGGTCACCTTGAAGGAGTCTGGTCCTGTG<br>CTGGTGAAACCCACA<u>GAG</u>ACCCTCACGCTG<br>ACCTGCACC<u>GTG</u>TCTGGGTTCTCACTCAAC<br>AATGCTAGAATGGGTGTGAGCTGGATCCGT<br>CAGCCCCCAGGGAAGGCCCTGGAGTGGCTT<br>GCACACATTTTTTCGAATGACGAAAAATCC<br>TACAGCACATCTCTGAAGAGCAGGCTCACC<br>ATCTCCAAGGACACCTCCAAAAGCCAGGTG<br>GTCCTA<u>AC</u>CATGACCAACATG<u>GA</u>CCCTGTG<br>GACACAGCCACATATTACTGTGCACGG<u>TCA</u><br>GTAGTAACTGGCGGCTAC<u>TAC</u>TAC<u>GAC</u>GGT<br>ATGGACGTCTGGGGCCAAGGGACC<u>AC</u>GGTC<br>ACCGTCTCTAGTGCCTCCACCAAGGGCCCA<br>TCGGTCTTCCCCCTGGCGCCCTGCTCCAGGA<br>GCACCTCCGAGAGCACAGCGGCCCTGGGCT<br>GCCTGGTCAAGGACTACTTCCCCGAACCGG<br>TGACGGTGTCGTGGAACTCAGGCGCTCTGA<br>CCAGCGGCGTGCACACCTTCCCAGCTGTCC<br>TACAGTCCTCAGGACTCTACTCCCTCAGCA<br>GCGTGGTGACCGTGCCCTCCAGCAACTTCG<br>GCACCCAGACCTACACCTGCAACGTAGATC<br>ACAAGCCCAGCAACACCAAGGTGGACAAG<br>ACAGTTGAGCGCAAATGTTGTGTCGAGTGC<br>CCACCGTGCCCAGCACCACCTGTGGCAGGA<br>CCGTCAGTCTTCCTCTTCCCCCCAAAACCCA<br>AGGACACCCTCATGATCTCCCGGACCCCTG<br>AGGTCACGTGCGTGGTGGTGGACGTGAGCC<br>ACGAAGACCCCGAGGTCCAGTTCAACTGGT<br>ACGTGGACGGCGTGGAGGTGCATAATGCCA<br>AGACAAAGCCACGGGAGGAGCAGTTCAAC<br>AGCACGTTCCGTGTGGTCAGCGTCCTCACC<br>GTTGTGCACCAGGACTGGCTGAACGGCAAG<br>GAGTACAAGTGCAAGGTCTCCAACAAAGGC<br>CTCCCAGCCCCCATCGAGAAAACCATCTCC<br>AAAACCAAAGGGCAGCCCCGAGAACCACA<br>GGTGTACACCCTGCCCCCATCCCGGGAGGA<br>GATGACCAAGAACCAGGTCAGCCTGACCTG<br>CCTGGTCAAAGGCTTCTACCCCAGCGACAT<br>CGCCGTGGAGTGGGAGAGCAATGGGCAGC<br>CGGAGAACAACTACAAGACCACACCTCCCA<br>TGCTGGACTCCGACGGCTCCTTCTTCCTCTA<br>CAGCAAGCTCACCGTGGACAAGAGCAGGT<br>GGCAGCAGGGGAACGTCTTCTCATGCTCCG<br>TGATGCATGAGGCTCTGCACAACCACTACA<br>CGCAGAAGAGCCTCTCCCTGTCTCCGGGTA<br>AA | 412 |
| 16H7 heavy chain | V24F + I83T | CAGGTCACCTTGAAGGAGTCTGGTCCTGTG<br>CTGGTGAAACCCACA<u>GAG</u>ACCCTCACGCTG<br>ACCTGCACC<u>TTC</u>TCTGGGTTCTCACTCAACA<br>ATGCTAGAATGGGTGTGAGCTGGATCCGTC<br>AGCCCCCAGGGAAGGCCCTGGAGTGGCTTG<br>CACACATTTTTTCGAATGACGAAAAATCCT<br>ACAGCACATCTCTGAAGAGCAGGCTCACCA<br>TCTCCAAGGACACCTCCAAAAGCCAGGTGG<br>TCCTA<u>AC</u>CATGACCAACATG<u>GA</u>CCCTGTGG<br>ACACAGCCACATATTACTGTGCACGG<u>TCAG</u><br>TAGTAACTGGCGGCTAC<u>TAC</u>TAC<u>GAC</u>GGTA<br>TGGACGTCTGGGGCCAAGGGACC<u>AC</u>GGTCA<br>CCGTCTCTAGTGCCTCCACCAAGGGCCCAT<br>CGGTCTTCCCCCTGGCGCCCTGCTCCAGGA<br>GCACCTCCGAGAGCACAGCGGCCCTGGGCT<br>GCCTGGTCAAGGACTACTTCCCCGAACCGG | 413 |

TABLE 6B-continued

Nucleic Acid Sequences of 16H7 and 22H5 Variants

| Core Sequence | Variation | Nucleic Acid Sequence | SEQ ID NO: |
|---|---|---|---|
| | | TGACGGTGTCGTGGAACTCAGGCGCTCTGA<br>CCAGCGGCGTGCACACCTTCCCAGCTGTCC<br>TACAGTCCTCAGGACTCTACTCCCTCAGCA<br>GCGTGGTGACCGTGCCCTCCAGCAACTTCG<br>GCACCCAGACCTACACCTGCAACGTAGATC<br>ACAAGCCCAGCAACACCAAGGTGGACAAG<br>ACAGTTGAGCGCAAATGTTGTGTCGAGTGC<br>CCACCGTGCCCAGCACCACCTGTGGCAGGA<br>CCGTCAGTCTTCCTCTTCCCCCCAAAACCCA<br>AGGACACCCTCATGATCTCCCGGACCCCTG<br>AGGTCACGTGCGTGGTGGTGGACGTGAGCC<br>ACGAAGACCCCGAGGTCCAGTTCAACTGGT<br>ACGTGGACGGCGTGGAGGTGCATAATGCCA<br>AGACAAAGCCACGGGAGGAGCAGTTCAAC<br>AGCACGTTCCGTGTGGTCAGCGTCCTCACC<br>GTTGTGCACCAGGACTGGCTGAACGGCAAG<br>GAGTACAAGTGCAAGGTCTCCAACAAAGGC<br>CTCCCAGCCCCCATCGAGAAAACCATCTCC<br>AAAACCAAAGGGCAGCCCCGAGAACCACA<br>GGTGTACACCCTGCCCCCATCCCGGGAGGA<br>GATGACCAAGAACCAGGTCAGCCTGACCTG<br>CCTGGTCAAAGGCTTCTACCCCAGCGACAT<br>CGCCGTGGAGTGGGAGAGCAATGGGCAGC<br>CGGAGAACAACTACAAGACCACACCTCCCA<br>TGCTGGACTCCGACGGCTCCTTCTTCCTCTA<br>CAGCAAGCTCACCGTGGACAAGAGCAGGT<br>GGCAGCAGGGGAACGTCTTCTCATGCTCCG<br>TGATGCATGAGGCTCTGCACAACCACTACA<br>CGCAGAAGAGCCTCTCCCTGTCTCCGGGTA<br>AA | |
| 16H7 heavy chain | E16Q + V24F + I83T | CAGGTCACCTTGAAGGAGTCTGGTCCTGTG<br>CTGGTGAAACCCACA<u>CAG</u>ACCCTCACGCTG<br>ACCTGCACC<u>TTC</u>TCTGGGTTCTCACTCAACA<br>ATGCTAGAATGGGTGTGAGCTGGATCCGTC<br>AGCCCCCAGGGAAGGCCCTGGAGTGGCTTG<br>CACACATTTTTTCGAATGACGAAAAATCCT<br>ACAGCACATCTCTGAAGAGCAGGCTCACCA<br>TCTCCAAGGACACCTCCAAAAGCCAGGTGG<br>TCCTA<u>ACC</u>ATGACCAACATG<u>GACCCTGTGG</u><br>ACACAGCCACATATTACTGTGCACGG<u>TCAG</u><br>TAGTAACTGGCGGCTAC<u>TAC</u>TACGACGGTA<br>TGGACGTCTGGGGCCAAGGGACC<u>AC</u>GGTCA<br>CCGTCTCTAGTGCCTCCACCAAGGGCCCAT<br>CGGTCTTCCCCCTGGCGCCCTGCTCCAGGA<br>GCACCTCCGAGAGCACAGCGGCCCTGGGCT<br>GCCTGGTCAAGGACTACTTCCCCGAACCGG<br>TGACGGTGTCGTGGAACTCAGGCGCTCTGA<br>CCAGCGGCGTGCACACCTTCCCAGCTGTCC<br>TACAGTCCTCAGGACTCTACTCCCTCAGCA<br>GCGTGGTGACCGTGCCCTCCAGCAACTTCG<br>GCACCCAGACCTACACCTGCAACGTAGATC<br>ACAAGCCCAGCAACACCAAGGTGGACAAG<br>ACAGTTGAGCGCAAATGTTGTGTCGAGTGC<br>CCACCGTGCCCAGCACCACCTGTGGCAGGA<br>CCGTCAGTCTTCCTCTTCCCCCCAAAACCCA<br>AGGACACCCTCATGATCTCCCGGACCCCTG<br>AGGTCACGTGCGTGGTGGTGGACGTGAGCC<br>ACGAAGACCCCGAGGTCCAGTTCAACTGGT<br>ACGTGGACGGCGTGGAGGTGCATAATGCCA<br>AGACAAAGCCACGGGAGGAGCAGTTCAAC<br>AGCACGTTCCGTGTGGTCAGCGTCCTCACC<br>GTTGTGCACCAGGACTGGCTGAACGGCAAG<br>GAGTACAAGTGCAAGGTCTCCAACAAAGGC<br>CTCCCAGCCCCCATCGAGAAAACCATCTCC<br>AAAACCAAAGGGCAGCCCCGAGAACCACA<br>GGTGTACACCCTGCCCCCATCCCGGGAGGA<br>GATGACCAAGAACCAGGTCAGCCTGACCTG<br>CCTGGTCAAAGGCTTCTACCCCAGCGACAT<br>CGCCGTGGAGTGGGAGAGCAATGGGCAGC<br>CGGAGAACAACTACAAGACCACACCTCCCA<br>TGCTGGACTCCGACGGCTCCTTCTTCCTCTA<br>CAGCAAGCTCACCGTGGACAAGAGCAGGT<br>GGCAGCAGGGGAACGTCTTCTCATGCTCCG<br>TGATGCATGAGGCTCTGCACAACCACTACA | 414 |

TABLE 6B-continued

Nucleic Acid Sequences of 16H7 and 22H5 Variants

| Core Sequence | Variation | Nucleic Acid Sequence | SEQ ID NO: |
|---|---|---|---|
| | | CGCAGAAGAGCCTCTCCCTGTCTCCGGGTAAA | |
| 16H7 heavy chain | E16Q + V24F + I83T + T119L | CAGGTCACCTTGAAGGAGTCTGGTCCTGTGCTGGTGAAACCCACA<u>CAG</u>ACCCTCACGCTGACCTGCACC<u>TTC</u>TCTGGGTTCTCACTCAACAATGCTAGAATGGGTGTGAGCTGGATCCGTCAGCCCCCAGGGAAGGCCCTGGAGTGGCTTGCACACATTTTTTCGAATGACGAAAAATCCTACAGCACATCTCTGAAGAGCAGGCTCACCATCTCCAAGGACACCTCCAAAAGCCAGGTGGTCCTA<u>ACC</u>ATGACCAACATG<u>GA</u>CCCTGTGGACACAGCCACATATTACTGTGCACGG<u>T</u>CAGTAGTAACTGGCGGCTAC<u>TAC</u>TAC<u>GA</u>CGGTATGGACGTCTGGGGCCAAGGGACC<u>CT</u>GGTCACCGTCTCTAGTGCCTCCACCAAGGGCCCATCGGTCTTCCCCCTGGCGCCCTGCTCCAGGAGCACCTCCGAGAGCACAGCGGCCCTGGGCTGCCTGGTCAAGGACTACTTCCCCGAACCGGTGACGGTGTCGTGGAACTCAGGCGCTCTGACCAGCGGCGTGCACACCTTCCCAGCTGTCCTACAGTCCTCAGGACTCTACTCCCTCAGCAGCGTGGTGACCGTGCCCTCCAGCAACTTCGGCACCCAGACCTACACCTGCAACGTAGATCACAAGCCCAGCAACACCAAGGTGGACAAGACAGTTGAGCGCAAATGTTGTGTCGAGTGCCCACCGTGCCCAGCACCACCTGTGGCAGGACCGTCAGTCTTCCTCTTCCCCCCAAAACCCAAGGACACCCTCATGATCTCCCGGACCCCTGAGGTCACGTGCGTGGTGGTGGACGTGAGCCACGAAGACCCCGAGGTCCAGTTCAACTGGTACGTGGACGGCGTGGAGGTGCATAATGCCAAGACAAAGCCACGGGAGGAGCAGTTCAACAGCACGTTCCGTGTGGTCAGCGTCCTCACCGTTGTGCACCAGGACTGGCTGAACGGCAAGGAGTACAAGTGCAAGGTCTCCAACAAAGGCCTCCCAGCCCCCATCGAGAAAACCATCTCCAAAACCAAAGGGCAGCCCCGAGAACCACAGGTGTACACCCTGCCCCCATCCCGGGAGGAGATGACCAAGAACCAGGTCAGCCTGACCTGCCTGGTCAAAGGCTTCTACCCCAGCGACATCGCCGTGGAGTGGGAGAGCAATGGGCAGCCGGAGAACAACTACAAGACCACACCTCCCATGCTGGACTCCGACGGCTCCTTCTTCCTCTACAGCAAGCTCACCGTGGACAAGAGCAGGTGGCAGCAGGGGAACGTCTTCTCATGCTCCGTGATGCATGAGGCTCTGCACAACCACTACACGCAGAAGAGCCTCTCCCTGTCTCCGGGTAAA | 415 |
| 16H7 heavy chain | E16Q + V24F + I83T + S100I + T119L | CAGGTCACCTTGAAGGAGTCTGGTCCTGTGCTGGTGAAACCCACA<u>CAG</u>ACCCTCACGCTGACCTGCACC<u>TTC</u>TCTGGGTTCTCACTCAACAATGCTAGAATGGGTGTGAGCTGGATCCGTCAGCCCCCAGGGAAGGCCCTGGAGTGGCTTGCACACATTTTTTCGAATGACGAAAAATCCTACAGCACATCTCTGAAGAGCAGGCTCACCATCTCCAAGGACACCTCCAAAAGCCAGGTGGTCCTA<u>ACC</u>ATGACCAACATG<u>GA</u>CCCTGTGGACACAGCCACATATTACTGTGCACGG<u>ATCG</u>TAGTAACTGGCGGCTAC<u>TAC</u>TAC<u>GA</u>CGGTATGGACGTCTGGGGCCAAGGGACC<u>CT</u>GGTCACCGTCTCTAGTGCCTCCACCAAGGGCCCATCGGTCTTCCCCCTGGCGCCCTGCTCCAGGAGCACCTCCGAGAGCACAGCGGCCCTGGGCTGCCTGGTCAAGGACTACTTCCCCGAACCGGTGACGGTGTCGTGGAACTCAGGCGCTCTGACCAGCGGCGTGCACACCTTCCCAGCTGTCCTACAGTCCTCAGGACTCTACTCCCTCAGCAGCGTGGTGACCGTGCCCTCCAGCAACTTCGGCACCCAGACCTACACCTGCAACGTAGATCACAAGCCCAGCAACACCAAGGTGGACAAGACAGTTGAGCGCAAATGTTGTGTCGAGTGCCCACCGTGCCCAGCACCACCTGTGGCAGGACCGTCAGTCTTCCTCTTCCCCCCAAAACCCA | 416 |

TABLE 6B-continued

Nucleic Acid Sequences of 16H7 and 22H5 Variants

| Core Sequence | Variation | Nucleic Acid Sequence | SEQ ID NO: |
|---|---|---|---|
| | | AGGACACCCTCATGATCTCCCGGACCCCTG<br>AGGTCACGTGCGTGGTGGTGGACGTGAGCC<br>ACGAAGACCCCGAGGTCCAGTTCAACTGGT<br>ACGTGGACGGCGTGGAGGTGCATAATGCCA<br>AGACAAAGCCACGGGAGGAGCAGTTCAAC<br>AGCACGTTCCGTGTGGTCAGCGTCCTCACC<br>GTTGTGCACCAGGACTGGCTGAACGGCAAG<br>GAGTACAAGTGCAAGGTCTCCAACAAAGGC<br>CTCCCAGCCCCCATCGAGAAAACCATCTCC<br>AAAACCAAAGGGCAGCCCCGAGAACCACA<br>GGTGTACACCCTGCCCCCATCCCGGGAGGA<br>GATGACCAAGAACCAGGTCAGCCTGACCTG<br>CCTGGTCAAAGGCTTCTACCCCAGCGACAT<br>CGCCGTGGAGTGGGAGAGCAATGGGCAGC<br>CGGAGAACAACTACAAGACCACACCTCCCA<br>TGCTGGACTCCGACGGCTCCTTCTTCCTCTA<br>CAGCAAGCTCACCGTGGACAAGAGCAGGT<br>GGCAGCAGGGGAACGTCTTCTCATGCTCCG<br>TGATGCATGAGGCTCTGCACAACCACTACA<br>CGCAGAAGAGCCTCTCCCTGTCTCCGGGTA<br>AA | |
| 16H7 heavy chain | I83K | CAGGTCACCTTGAAGGAGTCTGGTCCTGTG<br>CTGGTGAAACCCACA<u>GAG</u>ACCCTCACGCTG<br>ACCTGCACC<u>GTG</u>TCTGGGTTCTCACTCAAC<br>AATGCTAGAATGGGTGTGAGCTGGATCCGT<br>CAGCCCCCAGGGAAGGCCCTGGAGTGGCTT<br>GCACACATTTTTTCGAATGACGAAAAATCC<br>TACAGCACATCTCTGAAGAGCAGGCTCACC<br>ATCTCCAAGGACACCTCCAAAAGCCAGGTG<br>GTCCTA<u>AAG</u>ATGACCAACATG<u>GACCCTGTG</u><br>GACACAGCCACATATTACTGTGCACGG<u>TCA</u><br>GTAGTAACTGGCGGCTAC<u>TAC</u>TAC<u>GAC</u>GGT<br>ATGGACGTCTGGGGCCAAGGGACC<u>AC</u>GGTC<br>ACCGTCTCTAGTGCCTCCACCAAGGGCCCA<br>TCGGTCTTCCCCCTGGCGCCCTGCTCCAGGA<br>GCACCTCCGAGAGCACAGCGGCCCTGGGCT<br>GCCTGGTCAAGGACTACTTCCCCGAACCGG<br>TGACGGTGTCGTGGAACTCAGGCGCTCTGA<br>CCAGCGGCGTGCACACCTTCCCAGCTGTCC<br>TACAGTCCTCAGGACTCTACTCCCTCAGCA<br>GCGTGGTGACCGTGCCCTCCAGCAACTTCG<br>GCACCCAGACCTACACCTGCAACGTAGATC<br>ACAAGCCCAGCAACACCAAGGTGGACAAG<br>ACAGTTGAGCGCAAATGTTGTGTCGAGTGC<br>CCACCGTGCCCAGCACCACCTGTGGCAGGA<br>CCGTCAGTCTTCCTCTTCCCCCCAAAACCCA<br>AGGACACCCTCATGATCTCCCGGACCCCTG<br>AGGTCACGTGCGTGGTGGTGGACGTGAGCC<br>ACGAAGACCCCGAGGTCCAGTTCAACTGGT<br>ACGTGGACGGCGTGGAGGTGCATAATGCCA<br>AGACAAAGCCACGGGAGGAGCAGTTCAAC<br>AGCACGTTCCGTGTGGTCAGCGTCCTCACC<br>GTTGTGCACCAGGACTGGCTGAACGGCAAG<br>GAGTACAAGTGCAAGGTCTCCAACAAAGGC<br>CTCCCAGCCCCCATCGAGAAAACCATCTCC<br>AAAACCAAAGGGCAGCCCCGAGAACCACA<br>GGTGTACACCCTGCCCCCATCCCGGGAGGA<br>GATGACCAAGAACCAGGTCAGCCTGACCTG<br>CCTGGTCAAAGGCTTCTACCCCAGCGACAT<br>CGCCGTGGAGTGGGAGAGCAATGGGCAGC<br>CGGAGAACAACTACAAGACCACACCTCCCA<br>TGCTGGACTCCGACGGCTCCTTCTTCCTCTA<br>CAGCAAGCTCACCGTGGACAAGAGCAGGT<br>GGCAGCAGGGGAACGTCTTCTCATGCTCCG<br>TGATGCATGAGGCTCTGCACAACCACTACA<br>CGCAGAAGAGCCTCTCCCTGTCTCCGGGTA<br>AA | 417 |
| 16H7 heavy chain | S100I | CAGGTCACCTTGAAGGAGTCTGGTCCTGTG<br>CTGGTGAAACCCACA<u>GAG</u>ACCCTCACGCTG<br>ACCTGCACC<u>GTG</u>TCTGGGTTCTCACTCAAC<br>AATGCTAGAATGGGTGTGAGCTGGATCCGT<br>CAGCCCCCAGGGAAGGCCCTGGAGTGGCTT<br>GCACACATTTTTTCGAATGACGAAAAATCC | 418 |

TABLE 6B-continued

Nucleic Acid Sequences of 16H7 and 22H5 Variants

| Core Sequence | Variation | Nucleic Acid Sequence | SEQ ID NO: |
|---|---|---|---|
| | | TACAGCACATCTCTGAAGAGCAGGCTCACC ATCTCCAAGGACACCTCCAAAAGCCAGGTG GTCCTA<u>ATT</u>ATGACCAACATGG<u>ACCCT</u>GTG GACACAGCCACATATTACTGTGCACGG<u>ATC</u> GTAGTAACTGGCGGCTAC<u>TAC</u>TAC<u>GAC</u>GGT ATGGACGTCTGGGGCCAAGGGACC<u>AC</u>GGTC ACCGTCTCTAGTGCCTCCACCAAGGGCCCA TCGGTCTTCCCCCTGGCGCCCTGCTCCAGGA GCACCTCCGAGAGCACAGCGGCCCTGGGCT GCCTGGTCAAGGACTACTTCCCCGAACCGG TGACGGTGTCGTGGAACTCAGGCGCTCTGA CCAGCGGCGTGCACACCTTCCCAGCTGTCC TACAGTCCTCAGGACTCTACTCCCTCAGCA GCGTGGTGACCGTGCCCTCCAGCAACTTCG GCACCCAGACCTACACCTGCAACGTAGATC ACAAGCCCAGCAACACCAAGGTGGACAAG ACAGTTGAGCGCAAATGTTGTGTCGAGTGC CCACCGTGCCCAGCACCACCTGTGGCAGGA CCGTCAGTCTTCCTCTTCCCCCCAAAACCCA AGGACACCCTCATGATCTCCCGGACCCCTG AGGTCACGTGCGTGGTGGTGGACGTGAGCC ACGAAGACCCCGAGGTCCAGTTCAACTGGT ACGTGGACGGCGTGGAGGTGCATAATGCCA AGACAAAGCCACGGGAGGAGCAGTTCAAC AGCACGTTCCGTGTGGTCAGCGTCCTCACC GTTGTGCACCAGGACTGGCTGAACGGCAAG GAGTACAAGTGCAAGGTCTCCAACAAAGGC CTCCCAGCCCCCATCGAGAAAACCATCTCC AAAACCAAAGGGCAGCCCCGAGAACCACA GGTGTACACCCTGCCCCCATCCCGGGAGGA GATGACCAAGAACCAGGTCAGCCTGACCTG CCTGGTCAAAGGCTTCTACCCCAGCGACAT CGCCGTGGAGTGGGAGAGCAATGGGCAGC CGGAGAACAACTACAAGACCACACCTCCCA TGCTGGACTCCGACGGCTCCTTCTTCCTCTA CAGCAAGCTCACCGTGGACAAGAGCAGGT GGCAGCAGGGGAACGTCTTCTCATGCTCCG TGATGCATGAGGCTCTGCACAACCACTACA CGCAGAAGAGCCTCTCCCTGTCTCCGGGTA AA | |
| 16H7 heavy chain | D88R + P89A + V90E | CAGGTCACCTTGAAGGAGTCTGGTCCTGTG CTGGTGAAACCCACA<u>AGAGCTGAG</u>CTGCTG ACCTGCACC<u>GTG</u>TCTGGGTTCTCACTCAAC AATGCTAGAATGGGTGTGAGCTGGATCCGT CAGCCCCCAGGGAAGGCCCTGGAGTGGCTT GCACACATTTTTTCGAATGACGAAAAATCC TACAGCACATCTCTGAAGAGCAGGCTCACC ATCTCCAAGGACACCTCCAAAAGCCAGGTG GTCCTA<u>ATT</u>ATGACCAACATG<u>AGAGCTGAG</u> GACACAGCCACATATTACTGTGCACGG<u>TCA</u> GTAGTAACTGGCGGCTAC<u>TAC</u>TAC<u>GAC</u>GGT ATGGACGTCTGGGGCCAAGGGACC<u>AC</u>GGTC ACCGTCTCTAGTGCCTCCACCAAGGGCCCA TCGGTCTTCCCCCTGGCGCCCTGCTCCAGGA GCACCTCCGAGAGCACAGCGGCCCTGGGCT GCCTGGTCAAGGACTACTTCCCCGAACCGG TGACGGTGTCGTGGAACTCAGGCGCTCTGA CCAGCGGCGTGCACACCTTCCCAGCTGTCC TACAGTCCTCAGGACTCTACTCCCTCAGCA GCGTGGTGACCGTGCCCTCCAGCAACTTCG GCACCCAGACCTACACCTGCAACGTAGATC ACAAGCCCAGCAACACCAAGGTGGACAAG ACAGTTGAGCGCAAATGTTGTGTCGAGTGC CCACCGTGCCCAGCACCACCTGTGGCAGGA CCGTCAGTCTTCCTCTTCCCCCCAAAACCCA AGGACACCCTCATGATCTCCCGGACCCCTG AGGTCACGTGCGTGGTGGTGGACGTGAGCC ACGAAGACCCCGAGGTCCAGTTCAACTGGT ACGTGGACGGCGTGGAGGTGCATAATGCCA AGACAAAGCCACGGGAGGAGCAGTTCAAC AGCACGTTCCGTGTGGTCAGCGTCCTCACC GTTGTGCACCAGGACTGGCTGAACGGCAAG GAGTACAAGTGCAAGGTCTCCAACAAAGGC CTCCCAGCCCCCATCGAGAAAACCATCTCC | 419 |

TABLE 6B-continued

Nucleic Acid Sequences of 16H7 and 22H5 Variants

| Core Sequence | Variation | Nucleic Acid Sequence | SEQ ID NO: |
|---|---|---|---|
| | | AAAACCAAAGGGCAGCCCCGAGAACCACA<br>GGTGTACACCCTGCCCCCATCCCGGGAGGA<br>GATGACCAAGAACCAGGTCAGCCTGACCTG<br>CCTGGTCAAAGGCTTCTACCCCAGCGACAT<br>CGCCGTGGAGTGGGAGAGCAATGGGCAGC<br>CGGAGAACAACTACAAGACCACACCTCCCA<br>TGCTGGACTCCGACGGCTCCTTCTTCCTCTA<br>CAGCAAGCTCACCGTGGACAAGAGCAGGT<br>GGCAGCAGGGGAACGTCTTCTCATGCTCCG<br>TGATGCATGAGGCTCTGCACAACCACTACA<br>CGCAGAAGAGCCTCTCCCTGTCTCCGGGTA<br>AA | |
| 16H7 heavy chain | D88R + P89A + V90E + S100I | CAGGTCACCTTGAAGGAGTCTGGTCCTGTG<br>CTGGTGAAACCCACA<u>GAG</u>ACCCTCACGCTG<br>ACCTGCACC<u>GTG</u>TCTGGGTTCTCACTCAAC<br>AATGCTAGAATGGGTGTGAGCTGGATCCGT<br>CAGCCCCCAGGGAAGGCCCTGGAGTGGCTT<br>GCACACATTTTTTCGAATGACGAAAAATCC<br>TACAGCACATCTCTGAAGAGCAGGCTCACC<br>ATCTCCAAGGACACCTCCAAAAGCCAGGTG<br>GTCCTA<u>ATT</u>ATGACCAACATG<u>AGAGCTGAG</u><br>GACACAGCCACATATTACTGTGCACGG<u>ATC</u><br>GTAGTAACTGGCGGCTAC<u>TAC</u>TAC<u>GAC</u>GGT<br>ATGGACGTCTGGGGCCAAGGGACC<u>AC</u>GGTC<br>ACCGTCTCTAGTGCCTCCACCAAGGGCCCA<br>TCGGTCTTCCCCCTGGCGCCCTGCTCCAGGA<br>GCACCTCCGAGAGCACAGCGGCCCTGGGCT<br>GCCTGGTCAAGGACTACTTCCCCGAACCGG<br>TGACGGTGTCGTGGAACTCAGGCGCTCTGA<br>CCAGCGGCGTGCACACCTTCCCAGCTGTCC<br>TACAGTCCTCAGGACTCTACTCCCTCAGCA<br>GCGTGGTGACCGTGCCCTCCAGCAACTTCG<br>GCACCCAGACCTACACCTGCAACGTAGATC<br>ACAAGCCCAGCAACACCAAGGTGGACAAG<br>ACAGTTGAGCGCAAATGTTGTGTCGAGTGC<br>CCACCGTGCCCAGCACCACCTGTGGCAGGA<br>CCGTCAGTCTTCCTCTTCCCCCCAAAACCCA<br>AGGACACCCTCATGATCTCCCGGACCCCTG<br>AGGTCACGTGCGTGGTGGTGGACGTGAGCC<br>ACGAAGACCCCGAGGTCCAGTTCAACTGGT<br>ACGTGGACGGCGTGGAGGTGCATAATGCCA<br>AGACAAAGCCACGGGAGGAGCAGTTCAAC<br>AGCACGTTCCGTGTGGTCAGCGTCCTCACC<br>GTTGTGCACCAGGACTGGCTGAACGGCAAG<br>GAGTACAAGTGCAAGGTCTCCAACAAAGGC<br>CTCCCAGCCCCCATCGAGAAAACCATCTCC<br>AAAACCAAAGGGCAGCCCCGAGAACCACA<br>GGTGTACACCCTGCCCCCATCCCGGGAGGA<br>GATGACCAAGAACCAGGTCAGCCTGACCTG<br>CCTGGTCAAAGGCTTCTACCCCAGCGACAT<br>CGCCGTGGAGTGGGAGAGCAATGGGCAGC<br>CGGAGAACAACTACAAGACCACACCTCCCA<br>TGCTGGACTCCGACGGCTCCTTCTTCCTCTA<br>CAGCAAGCTCACCGTGGACAAGAGCAGGT<br>GGCAGCAGGGGAACGTCTTCTCATGCTCCG<br>TGATGCATGAGGCTCTGCACAACCACTACA<br>CGCAGAAGAGCCTCTCCCTGTCTCCGGGTA<br>AA | 420 |
| 16H7 heavy chain | Deletion of Y107 | CAGGTCACCTTGAAGGAGTCTGGTCCTGTG<br>CTGGTGAAACCCACA<u>GAG</u>ACCCTCACGCTG<br>ACCTGCACC<u>GTG</u>TCTGGGTTCTCACTCAAC<br>AATGCTAGAATGGGTGTGAGCTGGATCCGT<br>CAGCCCCCAGGGAAGGCCCTGGAGTGGCTT<br>GCACACATTTTTTCGAATGACGAAAAATCC<br>TACAGCACATCTCTGAAGAGCAGGCTCACC<br>ATCTCCAAGGACACCTCCAAAAGCCAGGTG<br>GTCCTA<u>ATT</u>ATGACCAACATG<u>GACCCTGTG</u><br>GACACAGCCACATATTACTGTGCACGG<u>TCA</u><br>GTAGTAACTGGCGGCTAC|TAC<u>GAC</u>GGTATG<br>GACGTCTGGGGCCAAGGGACC<u>AC</u>GGTCACC<br>GTCTCTAGTGCCTCCACCAAGGGCCCATCG<br>GTCTTCCCCCTGGCGCCCTGCTCCAGGAGC<br>ACCTCCGAGAGCACAGCGGCCCTGGGCTGC | 421 |

TABLE 6B-continued

Nucleic Acid Sequences of 16H7 and 22H5 Variants

| Core Sequence | Variation | Nucleic Acid Sequence | SEQ ID NO: |
|---|---|---|---|
| | | CTGGTCAAGGACTACTTCCCCGAACCGGTG<br>ACGGTGTCGTGGAACTCAGGCGCTCTGACC<br>AGCGGCGTGCACACCTTCCCAGCTGTCCTA<br>CAGTCCTCAGGACTCTACTCCCTCAGCAGC<br>GTGGTGACCGTGCCCTCCAGCAACTTCGGC<br>ACCCAGACCTACACCTGCAACGTAGATCAC<br>AAGCCCAGCAACACCAAGGTGGACAAGAC<br>AGTTGAGCGCAAATGTTGTGTCGAGTGCCC<br>ACCGTGCCCAGCACCACCTGTGGCAGGACC<br>GTCAGTCTTCCTCTTCCCCCCAAAACCCAAG<br>GACACCCTCATGATCTCCCGGACCCCTGAG<br>GTCACGTGCGTGGTGGTGGACGTGAGCCAC<br>GAAGACCCCGAGGTCCAGTTCAACTGGTAC<br>GTGGACGGCGTGGAGGTGCATAATGCCAAG<br>ACAAAGCCACGGGAGGAGCAGTTCAACAG<br>CACGTTCCGTGTGGTCAGCGTCCTCACCGTT<br>GTGCACCAGGACTGGCTGAACGGCAAGGA<br>GTACAAGTGCAAGGTCTCCAACAAAGGCCT<br>CCCAGCCCCCATCGAGAAAACCATCTCCAA<br>AACCAAAGGGCAGCCCCGAGAACCACAGG<br>TGTACACCCTGCCCCCATCCCGGGAGGAGA<br>TGACCAAGAACCAGGTCAGCCTGACCTGCC<br>TGGTCAAAGGCTTCTACCCCAGCGACATCG<br>CCGTGGAGTGGGAGAGCAATGGGCAGCCG<br>GAGAACAACTACAAGACCACACCTCCCATG<br>CTGGACTCCGACGGCTCCTTCTTCCTCTACA<br>GCAAGCTCACCGTGGACAAGAGCAGGTGG<br>CAGCAGGGGAACGTCTTCTCATGCTCCGTG<br>ATGCATGAGGCTCTGCACAACCACTACACG<br>CAGAAGAGCCTCTCCCTGTCTCCGGGTAAA | |
| 16H7 heavy chain | D109S | CAGGTCACCTTGAAGGAGTCTGGTCCTGTG<br>CTGGTGAAACCCACAGAGACCCTCACGCTG<br>ACCTGCACCGTGTCTGGGTTCTCACTCAAC<br>AATGCTAGAATGGGTGTGAGCTGGATCCGT<br>CAGCCCCCAGGGAAGGCCCTGGAGTGGCTT<br>GCACACATTTTTTCGAATGACGAAAAATCC<br>TACAGCACATCTCTGAAGAGCAGGCTCACC<br>ATCTCCAAGGACACCTCCAAAAGCCAGGTG<br>GTCCTAATTATGACCAACATGGACCCTGTG<br>GACACAGCCACATATTACTGTGCACGGTCA<br>GTAGTAACTGGCGGCTACTACTACAGCGGT<br>ATGGACGTCTGGGGCCAAGGGACCACGGTC<br>ACCGTCTCTAGTGCCTCCACCAAGGGCCCA<br>TCGGTCTTCCCCCTGGCGCCCTGCTCCAGGA<br>GCACCTCCGAGAGCACAGCGGCCCTGGGCT<br>GCCTGGTCAAGGACTACTTCCCCGAACCGG<br>TGACGGTGTCGTGGAACTCAGGCGCTCTGA<br>CCAGCGGCGTGCACACCTTCCCAGCTGTCC<br>TACAGTCCTCAGGACTCTACTCCCTCAGCA<br>GCGTGGTGACCGTGCCCTCCAGCAACTTCG<br>GCACCCAGACCTACACCTGCAACGTAGATC<br>ACAAGCCCAGCAACACCAAGGTGGACAAG<br>ACAGTTGAGCGCAAATGTTGTGTCGAGTGC<br>CCACCGTGCCCAGCACCACCTGTGGCAGGA<br>CCGTCAGTCTTCCTCTTCCCCCCAAAACCCA<br>AGGACACCCTCATGATCTCCCGGACCCCTG<br>AGGTCACGTGCGTGGTGGTGGACGTGAGCC<br>ACGAAGACCCCGAGGTCCAGTTCAACTGGT<br>ACGTGGACGGCGTGGAGGTGCATAATGCCA<br>AGACAAAGCCACGGGAGGAGCAGTTCAAC<br>AGCACGTTCCGTGTGGTCAGCGTCCTCACC<br>GTTGTGCACCAGGACTGGCTGAACGGCAAG<br>GAGTACAAGTGCAAGGTCTCCAACAAAGGC<br>CTCCCAGCCCCCATCGAGAAAACCATCTCC<br>AAAACCAAAGGGCAGCCCCGAGAACCACA<br>GGTGTACACCCTGCCCCCATCCCGGGAGGA<br>GATGACCAAGAACCAGGTCAGCCTGACCTG<br>CCTGGTCAAAGGCTTCTACCCCAGCGACAT<br>CGCCGTGGAGTGGGAGAGCAATGGGCAGC<br>CGGAGAACAACTACAAGACCACACCTCCCA<br>TGCTGGACTCCGACGGCTCCTTCTTCCTCTA<br>CAGCAAGCTCACCGTGGACAAGAGCAGGT<br>GGCAGCAGGGGAACGTCTTCTCATGCTCCG<br>TGATGCATGAGGCTCTGCACAACCACTACA | 422 |

TABLE 6B-continued

Nucleic Acid Sequences of 16H7 and 22H5 Variants

| Core Sequence | Variation | Nucleic Acid Sequence | SEQ ID NO: |
|---|---|---|---|
| | | CGCAGAAGAGCCTCTCCCTGTCTCCGGGTA AA | |
| 22H5 light chain | N92Q | TCCTATGTGCTGACTCAGCCACCCTCGGTGT CAGTGGCCCCAGGACAGACGGCCAGGATTA CCTGTGGGGGAAACAACATTGGAAGTCAAA GTGTGCACTGGTACCAGCAGAAGCCAGGCC AGGCCCCTGTCCTGGTCGTCTATGATGATA GCGACCGGCCCTCAGGGATCCCTGAGCGAT TCTCTGGTTCCAACTCTGGGAACACGGCCA CCCTGACCATCAGCAGGGTCGAAGCCGGGG ATGAGGCCGACTATTACTGTCAGGTGTGGG ATCAGACTAGTGATCATGTGGTATTCGGCG GGGGGACCAAGCTGACCGTCCTAGGTCAGC CCAAGGCCAACCCCACTGTCACTCTGTTCC CGCCCTCCTCTGAGGAGCTCCAAGCCAACA AGGCCACACTAGTGTGTCTGATCAGTGACT TCTACCCGGGAGCTGTGACAGTGGCCTGGA AGGCAGATGGCAGCCCCGTCAAGGCGGGA GTGGAGACCACCAAACCCTCCAAACAGAGC AACAACAAGTACGCGGCCAGCAGCTACCTG AGCCTGACGCCCGAGCAGTGGAAGTCCCAC AGAAGCTACAGCTGCCAGGTCACGCATGAA GGGAGCACCGTGGAGAAGACAGTGGCCCC TACAGAATGTTCA | 423 |
| 22H5 light chain | S94A | TCCTATGTGCTGACTCAGCCACCCTCGGTGT CAGTGGCCCCAGGACAGACGGCCAGGATTA CCTGTGGGGGAAACAACATTGGAAGTCAAA GTGTGCACTGGTACCAGCAGAAGCCAGGCC AGGCCCCTGTCCTGGTCGTCTATGATGATA GCGACCGGCCCTCAGGGATCCCTGAGCGAT TCTCTGGTTCCAACTCTGGGAACACGGCCA CCCTGACCATCAGCAGGGTCGAAGCCGGGG ATGAGGCCGACTATTACTGTCAGGTGTGGG ATAATACTGCTGATCATGTGGTATTCGGCG GGGGGACCAAGCTGACCGTCCTAGGTCAGC CCAAGGCCAACCCCACTGTCACTCTGTTCC CGCCCTCCTCTGAGGAGCTCCAAGCCAACA AGGCCACACTAGTGTGTCTGATCAGTGACT TCTACCCGGGAGCTGTGACAGTGGCCTGGA AGGCAGATGGCAGCCCCGTCAAGGCGGGA GTGGAGACCACCAAACCCTCCAAACAGAGC AACAACAAGTACGCGGCCAGCAGCTACCTG AGCCTGACGCCCGAGCAGTGGAAGTCCCAC AGAAGCTACAGCTGCCAGGTCACGCATGAA GGGAGCACCGTGGAGAAGACAGTGGCCCC TACAGAATGTTCA | 424 |
| 22H5 heavy chain | C109S | CAGGTCACCTTGAAGGAGTCTGGTCCTGTG CTGGTGAAACCCACAGAGACCCTCACGCTG ACCTGCACCGTGTCTGGGTTCTCACTCAGC AATGCTAGAATGGGTGTGAGCTGGATCCGT CAGCCCCCAGGGAAGGCCCTGGAGTGGCTT GCACACATTTTTTCGAATGACGAAAAATCC TACAGCACATCTCTGAAGAGCAGGCTCACC ATCTCCAAGGACACCTCCAAAAGCCAGGTG GTCCTTACCATGACCAACATGGACCCTGTG GACACAGCCACATATTACTGTGCACGGATA TTATTAGTGGGAGCTTACTACTACAGCGGT ATGGACGTCTGGGGCCAAGGGACCACGGTC ACCGTCTCTAGTGCCTCCACCAAGGGCCCA TCGGTCTTCCCCCTGGCGCCCTGCTCCAGGA GCACCTCCGAGAGCACAGCGGCCCTGGGCT GCCTGGTCAAGGACTACTTCCCCGAACCGG TGACGGTGTCGTGGAACTCAGGCGCTCTGA CCAGCGGCGTGCACACCTTCCCAGCTGTCC TACAGTCCTCAGGACTCTACTCCCTCAGCA GCGTGGTGACCGTGCCCTCCAGCAACTTCG GCACCCAGACCTACACCTGCAACGTAGATC ACAAGCCCAGCAACACCAAGGTGGACAAG ACAGTTGAGCGCAAATGTTGTGTCGAGTGC CCACCGTGCCCAGCACCACCTGTGGCAGGA CCGTCAGTCTTCCTCTTCCCCCCAAAACCCA AGGACACCCTCATGATCTCCCGGACCCCTG | 425 |

TABLE 6B-continued

Nucleic Acid Sequences of 16H7 and 22H5 Variants

| Core Sequence | Variation | Nucleic Acid Sequence | SEQ ID NO: |
|---|---|---|---|
| | | AGGTCACGTGCGTGGTGGTGGACGTGAGCC ACGAAGACCCCGAGGTCCAGTTCAACTGGT ACGTGGACGGCGTGGAGGTGCATAATGCCA AGACAAAGCCACGGGAGGAGCAGTTCAAC AGCACGTTCCGTGTGGTCAGCGTCCTCACC GTTGTGCACCAGGACTGGCTGAACGGCAAG GAGTACAAGTGCAAGGTCTCCAACAAAGGC CTCCCAGCCCCCATCGAGAAAACCATCTCC AAAACCAAAGGGCAGCCCCGAGAACCACA GGTGTACACCCTGCCCCCATCCCGGGAGGA GATGACCAAGAACCAGGTCAGCCTGACCTG CCTGGTCAAAGGCTTCTACCCCAGCGACAT CGCCGTGGAGTGGGAGAGCAATGGGCAGC CGGAGAACAACTACAAGACCACACCTCCCA TGCTGGACTCCGACGGCTCCTTCTTCCTCTA CAGCAAGCTCACCGTGGACAAGAGCAGGT GGCAGCAGGGGAACGTCTTCTCATGCTCCG TGATGCATGAGGCTCTGCACAACCACTACA CGCAGAAGAGCCTCTCCCTGTCTCCGGGTA AA | |
| 16H7 heavy chain | Insertion of Y107 | CAGGTCACCTTGAAGGAGTCTGGTCCTGTG CTGGTGAAACCCACA<u>GAG</u>ACCCTCACGCTG ACCTGCACC<u>GTGT</u>CTGGGTTCTCACTCAAC AATGCTAGAATGGGTGTGAGCTGGATCCGT CAGCCCCCAGGGAAGGCCCTGGAGTGGCTT GCACACATTTTTTCGAATGACGAAAAATCC TACAGCACATCTCTGAAGAGCAGGCTCACC ATCTCCAAGGACACCTCCAAAAGCCAGGTG GTCCTA<u>ATT</u>ATGACCAACATG<u>GACCCTGTG</u> GACACAGCCACATATTACTGTGCACGG<u>TCA</u> GTAGTAACTGGCGGCTACTATTACTAC<u>GAC</u> GGTATGGACGTCTGGGGCCAAGGGACC<u>ACG</u> GTCACCGTCTCTAGTGCCTCCACCAAGGGC CCATCGGTCTTCCCCCTGGCGCCCTGCTCCA GGAGCACCTCCGAGAGCACAGCGGCCCTGG GCTGCCTGGTCAAGGACTACTTCCCCGAAC CGGTGACGGTGTCGTGGAACTCAGGCGCTC TGACCAGCGGCGTGCACACCTTCCCAGCTG TCCTACAGTCCTCAGGACTCTACTCCCTCAG CAGCGTGGTGACCGTGCCCTCCAGCAACTT CGGCACCCAGACCTACACCTGCAACGTAGA TCACAAGCCCAGCAACACCAAGGTGGACA AGACAGTTGAGCGCAAATGTTGTGTCGAGT GCCCACCGTGCCCAGCACCACCTGTGGCAG GACCGTCAGTCTTCCTCTTCCCCCCAAAACC CAAGGACACCCTCATGATCTCCCGGACCCC TGAGGTCACGTGCGTGGTGGTGGACGTGAG CCACGAAGACCCCGAGGTCCAGTTCAACTG GTACGTGGACGGCGTGGAGGTGCATAATGC CAAGACAAAGCCACGGGAGGAGCAGTTCA ACAGCACGTTCCGTGTGGTCAGCGTCCTCA CCGTTGTGCACCAGGACTGGCTGAACGGCA AGGAGTACAAGTGCAAGGTCTCCAACAAA GGCCTCCCAGCCCCCATCGAGAAAACCATC TCCAAAACCAAAGGGCAGCCCCGAGAACC ACAGGTGTACACCCTGCCCCCATCCCGGGA GGAGATGACCAAGAACCAGGTCAGCCTGA CCTGCCTGGTCAAAGGCTTCTACCCCAGCG ACATCGCCGTGGAGTGGGAGAGCAATGGG CAGCCGGAGAACAACTACAAGACCACACCT CCCATGCTGGACTCCGACGGCTCCTTCTTCC TCTACAGCAAGCTCACCGTGGACAAGAGCA GGTGGCAGCAGGGGAACGTCTTCTCATGCT CCGTGATGCATGAGGCTCTGCACAACCACT ACACGCAGAAGAGCCTCTCCCTGTCTCCGG GTAAA | 426 |

TABLE 6C

CDR Amino Acid Sequences of Variants

| Core Sequence | Variation | Location of Mutation | CDR1 | CDR1 SEQ ID NO | CDR2 | CDR2 SEQ ID NO | CDR3 | CDR3 SEQ ID NO: |
|---|---|---|---|---|---|---|---|---|
| 16H7 light chain | Q16K | FW | GGNNIGSESV | 166 | DDSDRPS | 176 | QVWDGNSDHVV | 188 |
| 16H7 light chain | D49Y | CDR2 | GGNNIGSESVH | 166 | YDSDRPS | 427 | QVWDGNSDHVV | 188 |
| 16H7 light chain | D49A | CDR2 | GGNNIGSESVH | 166 | ADSDRPS | 428 | QVWDGNSDHVV | 188 |
| 16H7 light chain | D91A | CDR3 | GGNNIGSESVH | 166 | DDSDRPS | 176 | QVWAGNSDHVV | 429 |
| 16H7 light chain | D49A + D91A | CDR2, CDR3 | GGNNIGSESVH | 166 | ADSDRPS | 427 | QVWAGNSDHVV | 430 |
| 16H7 heavy chain | V24F | FW | NARMGVS | 122 | HIFSNDEKSYSTSLKS | 133 | SVVTGGYYYDGMDV | 148 |
| 16H7 heavy chain | I83T | FW | NARMGVS | 122 | HIFSNDEKSYSTSLKS | 133 | SVVTGGYYYDGMDV | 148 |
| 16H7 heavy chain | V24F + I83T | FW | NARMGVS | 122 | HIFSNDEKSYSTSLKS | 133 | SVVTGGYYYDGMDV | 148 |
| 16H7 heavy chain | E16Q + V24F + I83T | FW | NARMGVS | 122 | HIFSNDEKSYSTSLKS | 133 | SVVTGGYYYDGMDV | 148 |
| 16H7 heavy chain | E16Q + V24F + I83T + T119L | FW | NARMGVS | 122 | HIFSNDEKSYSTSLKS | 133 | SVVTGGYYYDGMDV | 148 |
| 16H7 heavy chain | E16Q + V24F + I83T + S100I + T119L | FW, CDR3 | NARMGVS | 122 | HIFSNDEKSYSTSLKS | 133 | IVVTGGYYYDGMDV | 431 |
| 16H7 heavy chain | I83K | FW | NARMGVS | 122 | HIFSNDEKSYSTSLKS | 133 | SVVTGGYYYDGMDV | 148 |
| 16H7 heavy chain | S100I | CDR3 | NARMGVS | 122 | HIFSNDEKSYSTSLKS | 133 | IVVTGGYYYDGMDV | 432 |
| 16H7 heavy chain | D88R + P89A + V90E | FW | NARMGDV | 122 | HIFSNDEKSYSTSLKS | 133 | SVVTGGYYYDGMDV | 148 |
| 16H7 heavy chain | D88R + P89A + V90E + S101I | FW, CDR3 | NARMGVS | 122 | HIFSNDEKSYSTSLKS | 133 | IVVTGGYYYDGMDV | 433 |
| 16H7 heavy chain | Deletion of Y107 | CDR3 | NARMGVS | 122 | HIFSNDEKSYSTSLKS | 133 | SVVTGGYYDGMDV | 434 |
| 16H7 heavy chain | D109S | CDR3 | NARMGVS | 122 | HIFSNDEKSYSTSLKS | 133 | SVVTGGYYYSGMDV | 435 |
| 22H5 light chain | N92Q | CDR3 | GGNNIGSQSVH | 167 | DDSDRPS | 176 | QVWDQTSDHVV | 436 |
| 22H5 light chain | S94A | CDR3 | GGNNIGSQSVH | 167 | DDSDRPS | 176 | QVWDNTADHVV | 437 |
| 22H5 heavy chain | C109S | CDR3 | NARMGVS | 122 | HIFSNDEKSYSTSLKS | 133 | ILLVGAYYYSGMDV | 438 |
| 16H7 heavy chain | Insertion of Y107 | CDR3 | NARMGVS | 122 | HIFSNDEKSYSTSLKS | 133 | SVVTGGYYYYDGMDV | 439 |

TABLE 6D

CDR Nucleic Acid Sequences of Variants

| Core Sequence | Variation | Location of Mutation | CDR1 | CDR1 SEQ ID NO | CDR2 | CDR2 SEQ ID NO | CDR3 | CDR3 SEQ ID NO: |
|---|---|---|---|---|---|---|---|---|
| 16H7 light chain | Q16K | FW | GGGGGAAACAACATTGGAAGTGAAAGTGTGCAC | 239 | GATGATAGCGACCGGCCCTC | 249 | CAGGTGTGGGATGGTAATAGTGATCATGTGGTA | 260 |
| 16H7 light chain | D49Y | CDR2 | GGGGGAAACAACATTGGAAGTGAAAGTGTGCAC | 239 | TATGATAGCGACCGGCCCTCA | 442 | CAGGTGTGGGATGGTAATAGTGATCATGTGGTA | 260 |
| 16H7 light chain | D49A | CDR2 | GGGGGAAACAACATTGGAAGTGAAAGTGTGCAC | 239 | GCTGATAGCGACCGGCCCTCA | 443 | CAGGTGTGGGATGGTAATAGTGATCATGTGGTA | 260 |
| 16H7 light chain | D91A | CDR3 | GGGGGAAACAACATTGGAAGTGAAAGTGTGCAC | 239 | GATGATAGCGACCGGCCCTCA | 249 | CAGGTGTGGGCTGGTAATAGTGACCATGTGGTA | 445 |
| 16H7 light chain | D49A + D91A | CDR2, CDR3 | GGGGGAAACAACATTGGAAGTGAAAGTGTGCAC | 239 | GCTGATAGCGACCGGCCCTCA | 444 | CAGGTGTGGGCTGGTAATAGTGACCATGTGGTA | 445 |
| 16H7 heavy chain | V24F | FW | AATGCTAGAATGGGTGTGAGC | 196 | CACATTTTTTCGAATGACGAAAAATCCTACAGCACATCTCTGAAGAGC | 206 | TCAGTAGTAACTGGCGGCTACTACTACGACGGTATGGACGTC | 221 |
| 16H7 heavy chain | I83T | FW | AATGCTAGAATGGGTGTGAGC | 196 | CACATTTTTTCGAATGACGAAAAATCCTACAGCACATCTCTGAAGAGC | 206 | TCAGTAGTAACTGGCGGCTACTACTACGACGGTATGGACGTC | 221 |
| 16H7 heavy chain | V24F + I83T | FW | AATGCTAGAATGGGTGTGAGC | 196 | CACATTTTTTGACGAAAAATCCTACAGCACATCTCTGAAGAGC | 206 | TCAGTAGTAACTGGCGGCTACTACTACGACGGTATGGACGTC | 221 |
| 16H7 heavy chain | E16Q + V24F + I83T | FW | AATGCTAGAATGGGTGTGAGC | 196 | CACATTTTTTCGAATGACGAAAAATCCTACAGCACATCTCTGAAGAGC | 206 | TCAGTAGTAACTGGCGGCTACTACTACGACGGTATGGACGTC | 221 |
| 16H7 heavy chain | E16Q + V24F + I83T + T19L | FW | AATGCTAGAATGGGTGTGAGC | 196 | CACATTTTTTCGAATGACGAAAAATCCTACAGCACATCTCTGAAGAGC | 206 | TCAGTAGTAACTGGCGGCTACTACTACGACGGTATGGACGTC | 221 |
| 16H7 heavy chain | E16Q + V24F + I83T + S100I + T119L | FW, CDR3 | AATGCTAGAATGGGTGTGAGC | 196 | CACATTTTTTCGAATGACGAAAAATCCTACAGCACATCTCTGAAGAGC | 206 | ATCGTAGTAACTGGCGGCTACTACTACGACGGTATGGACGTC | 446 |
| 16H7 heavy chain | I83K | FW | AATGCTAGAATGGGTGTGAGC | 196 | CACATTTTTTCGAATGACGAAAAATCCTACAGCACATCTCTGAAGAGC | 206 | TCAGTAGTAACTGGCGGCTACTACTACGACGGTATGGACGTC | 221 |
| 16H7 heavy chain | S100I | CDR3 | AATGCTAGAATGGGTGTGAGC | 196 | CACATTTTTTCGAATGACGAAAAATCCTACAGCACATCTCTGAAGAGC | 206 | ATCGTAGTAACTGGCGGCTACTACTACGACGGTATGGACGTC | 446 |
| 16H7 heavy chain | D88R + P89A + V90E | FW | AATGCTAGAATGGGTGTGAGC | 196 | CACATTTTTTCGAATGACGAAAAATCCTACAGCACATCTCTGAAGAGC | 206 | TCAGTAGTAACTGGCGGCTACTACTACGACGGTATGGACGTC | 221 |
| 16H7 heavy chain | D88R + P89A + V90E + S100I | FW, CDR3 | AATGCTAGAATGGGTGTGAGC | 196 | CACATTTTTTCGAATGACGAAAAATCCTACAGCACATCTCTGAAGAGC | 206 | ATCGTAGTAACTGGCGGCTACTACTACGACGGTATGGACGTC | 446 |
| 16H7 heavy chain | Deletion of Y107 | CDR3 | AATGCTAGAATGGGTGTGAGC | 196 | CACATTTTTTCGAATGACGAAAAATCCTACAGCACATCTCTGAAGAGC | 206 | TCAGTAGTAACTGGCGGCTACTACGACGGTATGGACGTC | 447 |

TABLE 6D-continued

CDR Nucleic Acid Sequences of Variants

| Core Sequence | Variation | Location of Mutation | CDR1 | SEQ ID NO CDR1 | CDR2 | SEQ ID NO CDR2 | CDR3 | SEQ ID NO: CDR3 |
|---|---|---|---|---|---|---|---|---|
| 16H7 heavy chain | D109S | CDR3 | AATGCTAGAATGGGT GTGAGC | 196 | CACATTTTTTCGAA TGACGAAAAATCCT ACAGCACATCTCTG AAGAGC | 206 | <u>TCA</u>GTAGTAACTGG CGGCTAC<u>TACTAC</u><u>A</u> <u>GC</u>GGTATGGACGTC | 448 |
| 22H5 light chain | N92Q | CDR3 | GGGGGAAACAACATT GGAAGTCAAAGTGTG CAC | 240 | GATGATAGCGACCG GCCCTCA | 249 | CAGGTGTGGGAT<u>CA</u> <u>G</u>ACTAGTGATCATG TGGTA | 449 |
| 22H5 light chain | S94A | CDR3 | GGGGGAAACAACATT GGAAGTCAAAGTGTG CAC | 240 | GATGATAGCGACCG GCCCTCA | 249 | CAGGTGTGGGATAA TACTGCTGATCATG TGGTA | 450 |
| 22H5 heavy chain | C109S | CDR3 | AATGCTAGAATGGGT GTGAGC | 196 | CACATTTTTTCGAA TGACGAAAAATCCT ACAGCACATCTCTG AAGAGC | 206 | ATATTATTAGTGGG AGCTTACTACTAC<u>A</u> <u>GC</u>GGTATGGACGTC | 451 |
| 16H7 heavy chain | Insertion of Y107 | CDR3 | AATGCTAGAATGGGT GTGAGC | 196 | CACATTTTTTCGAA TGACGAAAAATCCT ACAGCACATCTCTG AAGAGC | 206 | <u>TCA</u>GTAGTAACTGG CGGCTACTATTACT AC<u>GA</u>CGGTATGGAC GTC | 452 |

Additionally, a "hemibody" was generated and studied. This structure comprised the 16H7 light chain (L3; SEQ ID NO:50), which was paired with an engineered form of the 16H7 heavy chain; the engineered heavy chain comprised the 16H7 heavy chain (SEQ ID NO:32) joined via a $(G_4S)_8$ linker (SEQ ID NO:440) to an IgG2 Fc sequence (SEQ ID NO:441), which paired with the Fc sequence of the 16H7 heavy chain. The component parts of the hemibody have the following sequences:

```
16H7 Heavy Chain
                                      (SEQ ID NO: 32)
MDMRVPAQLLGLLLLWLRGARCQVTLKESGPVLVKPTETLTLTCTV
SGFSLNNARMGVSWIRQPPGKALEWLAHIFSNDEKSYSTSLKSRLT
ISKDTSKSQVVLIMTNMDPVDTATYYCARSVVTGGYYYDGMDVWGQ
GTTVTVSSASTKGPSVFPLAPCSRSTSESTAALGCLVKDYFPEPVT
VSWNSGALTSGVHTFPAVLQSSGLYSLSSVVTVPSSNFGTQTYTCN
VDHKPSNTKVDKTVERKSSVECPPCPAPPVAGPSVFLFPPKPKDTL
MISRTPEVTCVVVDVSHEDPEVQFNWYVDGVEVHNAKTKPREEQFN
STFRVVSVLTVVHQDWLNGKEYKCKVSNKGLPAPIEKTISKTKGQP
REPQVYTLPPSREEMTKNQVSLTCLVKGFYPSDIAVEWESNGQPEN
NYKTTPPMLDSDGSFFLYSKLTVDKSRWQQGNVFSCSVMHEALHNH
YTQKSLSLSP Linker
                                     (SEQ ID NO: 440)
GGGGSGGGGSGGGGSGGGGSGGGGSGGGGSGGGGSGGGGS IgG2 Fc
                                     (SEQ ID NO: 441)
ERKSSVECPPCPAPPVAGPSVFLFPPKPKDTLMISRTPEVTCVVVD
VSHEDPEVQFNWYVDGVEVHNAKTKPREEQFNSTFRVVSVLTVVHQ
DWLNGKEYKCKVSNKGLPAPIEKTISKTKGQPREPQVYTLPPSREE
MTKNQVSLTCLVKGFYPSDIAVEWESNGQPENNYKTTPPMLDSDGS
FFLYSKLTVDKSRWQQGNVFSCSVMHEALHNHYTQKSLSLSPGK
```

The full hemibody heavy chain had the amino acid sequence shown below:

```
                                     (SEQ ID NO: 453)
MDMRVPAQLLGLLLLSLRGARCQVTLKESGPVLVKPTETLTLTCTV
SGFSLNNARMGVSWIRQPPGKALEWLAHIFSNDEKSYSTSLKSRLT
ISKDTSKSQVVLIMTNMDPVDTATYYCARSVVTGGYYYDGMDVWGQ
GTTVTVSSASTKGPSVFPLAPCSRSTSESTAALGCLVKDYFPEPVT
VSWNSGALTSGVHTFPAVLQSSGLYSLSSVVTVPSSNFGTQTYTCN
VDHKPSNTKVDKTVERKSSVECPPCPAPPVAGPSVFLFPPKPKDTL
MISRTPEVTCVVVDVSHEDPEVQFNWYVDGVEVHANKTKPREEQFN
STFRVVSVLTVVHQDWLNGKEYKCKVSNKGLPAPIEKTISKTKGQP
REPQVYTLPPSREEMTKNQVSLTCLVKGFYPSDIAVEWESNGQPEN
NYKTTPPMLDSDGSFFLYSKLTVDKSRWQQGNVFSCSVMHEALHNH
YTQKSLSLSPGGGGSGGGGSGGGGSGGGGSGGGGSGGGGSGGGGS
GGGGSERKSSVECPPCPAPPVAGPSVFLFPPKPKDTLMISRTPEVT
CVVVDVSHEDPEVQFNWYVDGVEVHNAKTKPREEQFNSTFRVVSVL
TVVHQDWLNGKEYKCKVSNKGLPAPIEKTISKTKGQPREPQVYTLP
PSREEMTKNQVSLTCLVKGFYPSDIAVEWESNGQPENNYKTTPPPP
MLDSDGSFFLYSKLTVDKSRWQQGNVFSCSVMHEALHNHYTQKSLS
LSLPGK
``` which is encoded by the follow sequence:

```
                                     (SEQ ID NO: 454)
ATGGACATGAGGGTGCCCGCTCAGCTCCTGGGGCTCCTGCTGCTGT

GGCTGAGAGGTGCGCGCTGTCAGGTCACCTTGAAGGAGTCTGGTCC

TGTGCTGGTGAAACCCACAGAGACCCTCACGCTGACCTGCACCGTG

TCTGGGTTCTCACTCAACAATGCTAGAATGGGTGTGAGCTGGATCC

GTCAGCCCCCAGGGAAGGCCCTGGAGTGGCTTGCACACATTTTTTC

GAATGACGAAAAATCCTACAGCACATCTCTGAAGAGCAGGCTCACC
```

-continued

```
ATCTCCAAGGACACCTCCAAAAGCCAGGTGGTCCTAATTATGACCA
ACATGGACCCTGTGGACACAGCCACATATTACTGTGCACGGTCAGT
AGTAACTGGCGGCTACTACTACGACGGTATGGACGTCTGGGGCCAA
GGGACCACGGTCACCGTCTCTAGTGCCAGCACCAAGGGCCCCTCCG
TGTTCCCTCTGGCCCCTGCAGCAGAAGCACCAGCGAGAGCACAGC
CGCCCTGGGCTGCCTGGTCAAGGACTACTTCCCCGAGCCCGTGACC
GTGTCTTGGAACAGCGGAGCCCTGACCAGCGGCGTGCACACCTTTC
CAGCCGTGCTGCAGAGCAGCGGCCTGTACAGCCTGAGCAGCGTGGT
CACCGTGCCCAGCAGCAACTTCGGCACCCAGACCTACACCTGTAAC
GTGGACCACAAGCCCAGCAACACCAAGGTGGACAAGACAGTGGAGC
GGAAGTCCAGCGTGGAGTGCCCTCCTTGTCCTGCCCCTCCTGTGGC
CGGACCTAGCGTGTTCCTGTTCCCCCCAAAGCCCAAGGACACCCTG
ATGATCAGCCGGACCCCCGAAGTGACCTGCGTGGTGGTGGACGTGT
CCCACGAGGACCCCGAGGTGCAGTTCAATTGGTACGTGGACGGGGT
GGAGGTGCACAACGCCAAGACCAAGCCCGGGAGGAACAGTTCAAC
AGCACCTTCCGGGTGGTGTCCGTCCTCACCGTGGTGCACCAGGACT
GGCTGAACGGCAAAGAGTACAAGTGCAAGGTCTCCAACAAGGGCCT
GCCTGCCCCCATCGAGAAAACCATCAGCAAGACCAAGGGCCAGCCT
CGGGAGCCTCAGGTGTACACCCTGCCCCCAGCCGGGAGGAAATGA
CCAAGAACCAGGTGTCCCTGACCTGCCTCGTGAAGGGCTTCTACCC
CAGCGATATCGCCGTGGAGTGGGAGAGCAACGGCCAGCCCGAGAAC
AACTACAAGACCACCCCCCCCATGCTGGACAGCGACGGCAGCTTCT
TCCTGTACTCCAAACTGACCGTGGACAAGAGCCGGTGGCAGCAGGG
CAACGTGTTCAGCTGTAGCGTGATGCACGAGGCCCTGCACAACCAC
TACACCCAGAAGTCCCTGAGCCTGTCTCCTGGCGGAGGCGGAGGAT
CTGGCGGCGGAGGAAGTGGAGGGGGCGGATCTGGTGGTGGAGGCAG
CGGCGGAGGTGGAAGTGGCGGTGGAGGATCCGGTGGAGGCGGCTCA
GGTGGCGGCGGAAGCGAGAGAAAGTCCTCCGTGGAGTGTCCACCAT
GCCCTGCTCCACCAGTGGCTGGCCCTTCCGTCTTTCTCTTTCCACC
TAAACCTAAGGATACACTCATGATCTCCAGAACTCCAGAGGTCACA
TGTGTGGTCGTCGATGTCAGTCATGAGGATCCTGAAGTCCAGTTTA
ACTGGTATGTGGATGGCGTCGAAGTCCATAATGCTAAGACAAAACC
TCGCGAAGAACAGTTTAACTCCACCTTTAGAGTCGTGAGCGTGCTG
ACAGTCGTCCATCAGGATTGGCTCAATGGGAAAGAATACAAATGTA
AAGTCTCTAACAAAGGACTGCCCGCTCCTATCGAAAAGACCATCTC
CAAAACAAAGGGGCAGCCCAGAGAGCCCCAGGTCTACACACTCCCA
CCCTCCAGAGAAGAGATGACAAAAAATCAGGTGTCACTCACCTGTC
TGGTCAAGGGGTTTTACCCCTCCGACATTGCCGTGGAATGGGAATC
CAATGGGCAGCCTGAAAACAATTATAAGACTACACCTCCTATGCTC
GACTCTGATGGGAGTTTCTTTCTCTACTCTAAACTCACAGTGGATA
AGTCTAGATGGCAGCAGGGGAATGTCTTTTCCTGCTCCGTCATGCA
TGAAGCTCTCCACAATCATTATACACAGAAGTCTTTGTCCCTGTCC
CCCGGCAAG
```

Example 14.1

β-Klotho Binding ELISA for Engineered Antibodies

Figure 32A:
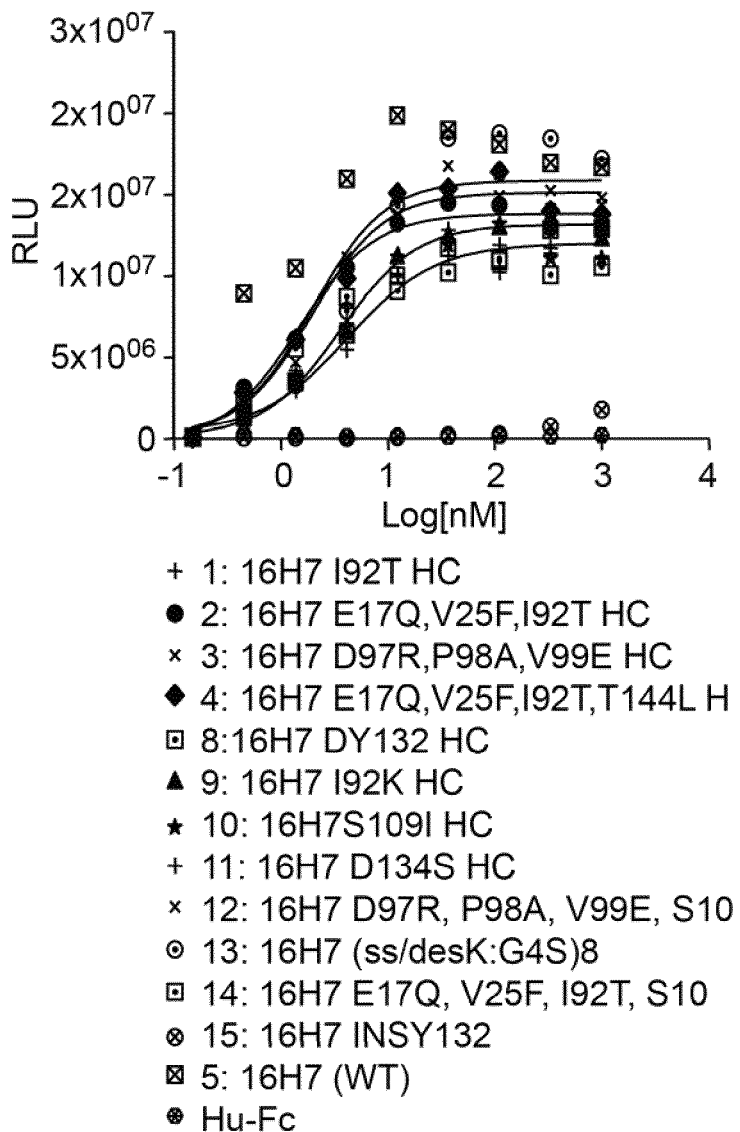
FIGS. 32A-C is a series of plots depicting the results of ELISA assays that were used to demonstrate that several of the 22H5 and 16H7 variants have binding ability.
Figure 32B:
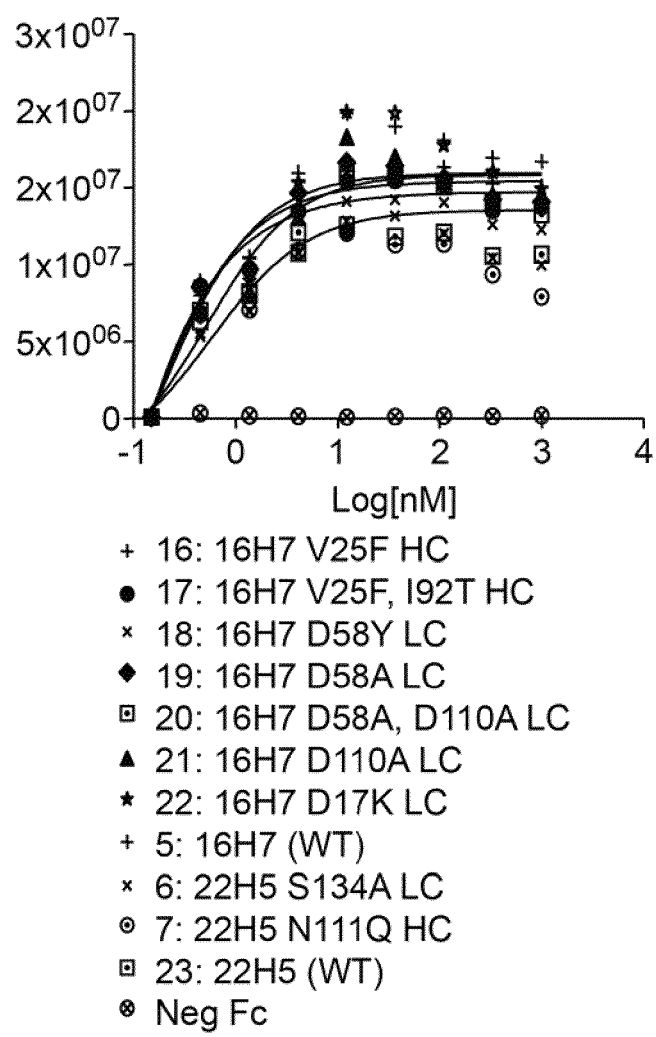
Figure 32C:
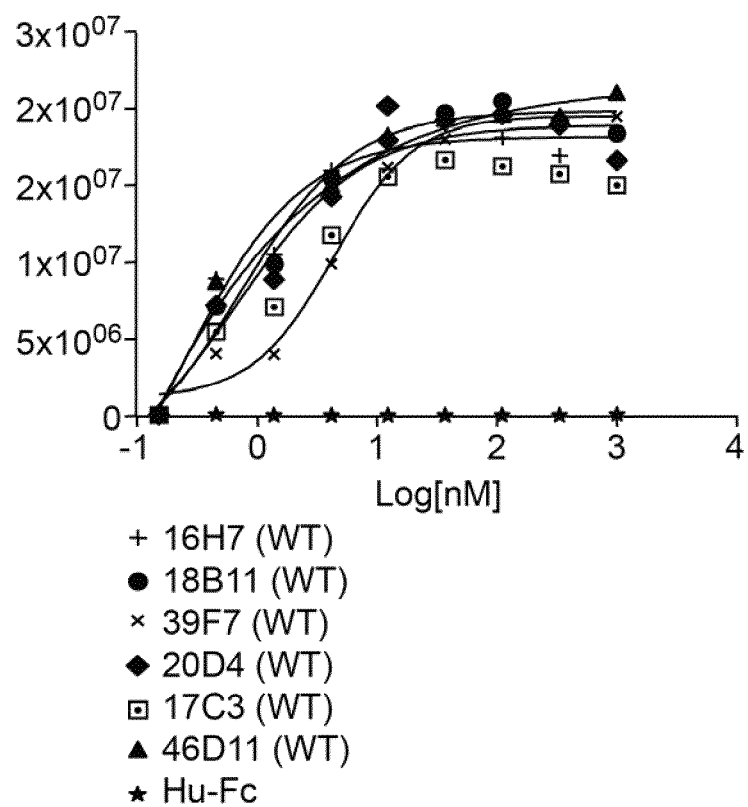

The engineered forms of 16H7 and 22H5 were tested for β-Klotho binding using an ELISA assay. Conditions for the ELISA were as follows.
Streptavidin coated Maxisorp plates were incubated with 2 μg/ml β-Klotho overnight at 4 degrees. Antibodies were added in 3-fold serial dilutions starting at 1 μM for 1 hour at room temp. HRP conjugated anti-human Fc was used as the detector antibody. Signal was developed with Lumiglo and read on Envision.
Results of the ELISA assay are shown in FIG. 32A-32C and indicate that most variants of 16H7 bound to human β-Klotho except for a mutant carrying insertion of tyrosine at position 107.

Example 14.2

Engineered Variants of 16H7 and 22H5 Bind to Native Receptor Structure, as Shown by FACS A FACS binding assay was performed with several of the engineered forms of 16H7 and 22H5. The experiments were performed as follows.
CHO cells stably expressing FGF21 receptor were treated with parent antibody 16H7 and 22H5 and also with engineered variants of them (1 μg per 1×10⁶ cells in 100 μl PBS/ 0.5% BSA). Cells were incubated with the antibodies at 4° C. followed by two washes with PBS/BSA. Cells were then treated with FITC-labeled secondary antibodies at 4° C. followed by two washes. The cells were resuspended in 1 ml PBS/BSA and antibody binding was analyzed using a FACS Calibur instrument.
Consistent with ELISA results, most of engineered variants of FGF21 receptor agonistic antibodies tested bind well to cell surface FGF21 receptor in FACS. This observation further confirmed that the guided engineering of FGF21 receptor agonistic antibodies maintain binding to the native structure. In one mutant, in which CDR3 was engineered to include a tyrosine at position Y107, a complete loss of binding to cell surface receptor was observed, which is similar to the ELISA results. This observation points to the role of CDR3 loop in binding to native conformation.

Example 14.3

Activity of 16H7 and 22H5 Variants in Primary Human Adipocytes

FGF21 stimulates glucose uptake and lipolysis in cultured adipocytes and, therefore, adipocytes are often considered to be a physiologically relevant assay. A panel of the engineered variants of 16H7 and 22H5 was shown to exhibit Erk-phosphorylation activity similar to FGF21 in the human adipocyte assay with an estimated EC50 less than 10 nM, as shown in Table 7.

TABLE 7

Activity of Variants in Human Adipocyte Assay

| Core Sequence | SEQ ID NO of Variant Chain | Variant | EC50 (nM) |
|---|---|---|---|
| 16H7 Heavy Chain | 391 | I83T | 0.73 |
| 16H7 Heavy Chain | 393 | E16Q + V24F + I83T | 0.38 |
| 16H7 Heavy Chain | 398 | D88R + P89A + V90E | 0.35 |
| 16H7 Heavy Chain | 394 | E16Q + V24F + I83T + T119L | 0.36 |
| 16H7 (WT) | | | 0.53 |
| 22H5 Light Chain | 403 | S94A | 1.98 |
| 22H5 Light Chain | 402 | N92Q | 3.33 |
| 16H7 Heavy Chain | 400 | Deletion of Y107 | 1.04 |
| 16H7 Heavy Chain | 396 | I83K | 0.39 |
| 16H7 Heavy Chain | 397 | S100I | 0.17 |
| 16H7 Heavy Chain | 401 | D109S | 0.31 |
| 16H7 Heavy Chain | 399 | D88R + P89A + V90E + S100I | 0.14 |
| 16H7 Heavy Chain | 395 | E16Q + V24F + I83T + S100I + T119L | 0.24 |
| 22H5 Heavy Chain | 405 | Insertion of Y107 | 0.51 |
| 16H7 Heavy Chain | 390 | V24F | 0.75 |
| 16H7 Heavy Chain | 392 | V24F + I83T | 0.37 |
| 16H7 Light Chain | 386 | D49Y | 0.60 |
| 16H7 Light Chain | 387 | D49A | 0.63 |
| 16H7 Light Chain | 389 | D49A, D91A | 1.4 |
| 16H7 Light Chain | 388 | D91A | 1.3 |
| 16H7 Light Chain | 385 | Q16K | 0.11 |
| 22H5 (WT) | | | 2.27 |

Example 14.4

Biacore™ Binding Experiments and Off-Rate Measurement

Binding of 16H7 and 22H5 variants to human β-Klotho was tested using Biacore™ assays. Briefly, mouse anti-His antibody (Qiagen™, Valencia, Calif.) was immobilized on a CM5 chip using amine coupling reagents (General Electronics™, Piscataway, N.J.). His-tagged human recombinant β-Klotho was captured on the second flow cell to ~100 RU. The first flow cell was used as a background control. 100 nM mAbs were diluted in PBS plus 0.1 mg/ml BSA, 0.005% P20 and injected over the β-Klotho captured on anti-His antibody surface. For kinetic measurement, 0.78~100 nM mAbs diluted in PBS plus 0.1 mg/ml BSA, 0.005% P20 were injected over the β-Klotho surface.

The variants tested are summarized in Table 8:

TABLE 8

Variants Studied in Binding and Off-rate Experiments

| Construct Number | Core Antigen Binding Protein | Heavy Chain Identifier/Variation | Light Chain Identifier/Variation | Heavy Chain SEQ ID NO | Light Chain SEQ ID NO |
|---|---|---|---|---|---|
| 22H5 | | H2 | L2 | 31 | 13 |
| #1, P60881.3 | 16H7 | I83T | L3 | 391 | 14 |
| #2, P60880.3 | 16H7 | E16Q + V24F + I83T | L3 | 393 | 14 |
| #3, P60890.3 | 16H7 | D88R + P89A + V90E | L3 | 398 | 14 |
| #4, P60878.3 | 16H7 | E16Q + V24F + I83T + T119L | L3 | 394 | 14 |
| #5, 16H7 WT | 16H7 | H3 | L3 | 32 | 14 |
| #6, P60898.3 | 22H5 | H2 | S94A | 31 | 403 |
| #7, P60897.3 | 22H5 | H2 | N92Q | 31 | 402 |
| #8, P60886.3 | 16H7 | Deletion of Y107 | L3 | 400 | 14 |
| #9, P60885.3 | 16H7 | I83K | L3 | 396 | 14 |
| #10, P60884.3 | 16H7 | S100I | L3 | 397 | 14 |
| #11, P60883.3 | 16H7 | D109S | L3 | 401 | 14 |
| #12, P60879.3 | 16H7 | D88R + P89A + V90E + S100I | L3 | 399 | 14 |
| #13, P60882.3 | 16H7 | Hemibody Heavy Chain | L3 | 453 | 14 |
| #14, P60891.3 | 16H7 | E16Q + V24F + I83T + S100I + T119L | L3 | 395 | 14 |
| #15, P60889.3 | 16H7 | Insertion of Y107 | L3 | 405 | 14 |
| #16, P60888.3 | 16H7 | V24F | L3 | 390 | 14 |
| #17, P60887.3 | 16H7 | V24F + I83T | L3 | 392 | 14 |
| #18, P60894.3 | 16H7 | H3 | D49Y | 32 | 386 |
| #19, P60895.3 | 16H7 | H3 | D49A | 32 | 387 |
| #20, P60893.3 | 16H7 | H3 | D49A + D91A | 32 | 389 |
| #21, P60892.3 | 16H7 | H3 | D91A | 32 | 388 |
| #22, P60896.3 | 16H7 | H3 | Q16K | 32 | 385 |
| #23, P60899.2 | 22H5 | C109S | L2 | 404 | 13 |

Figure 33:
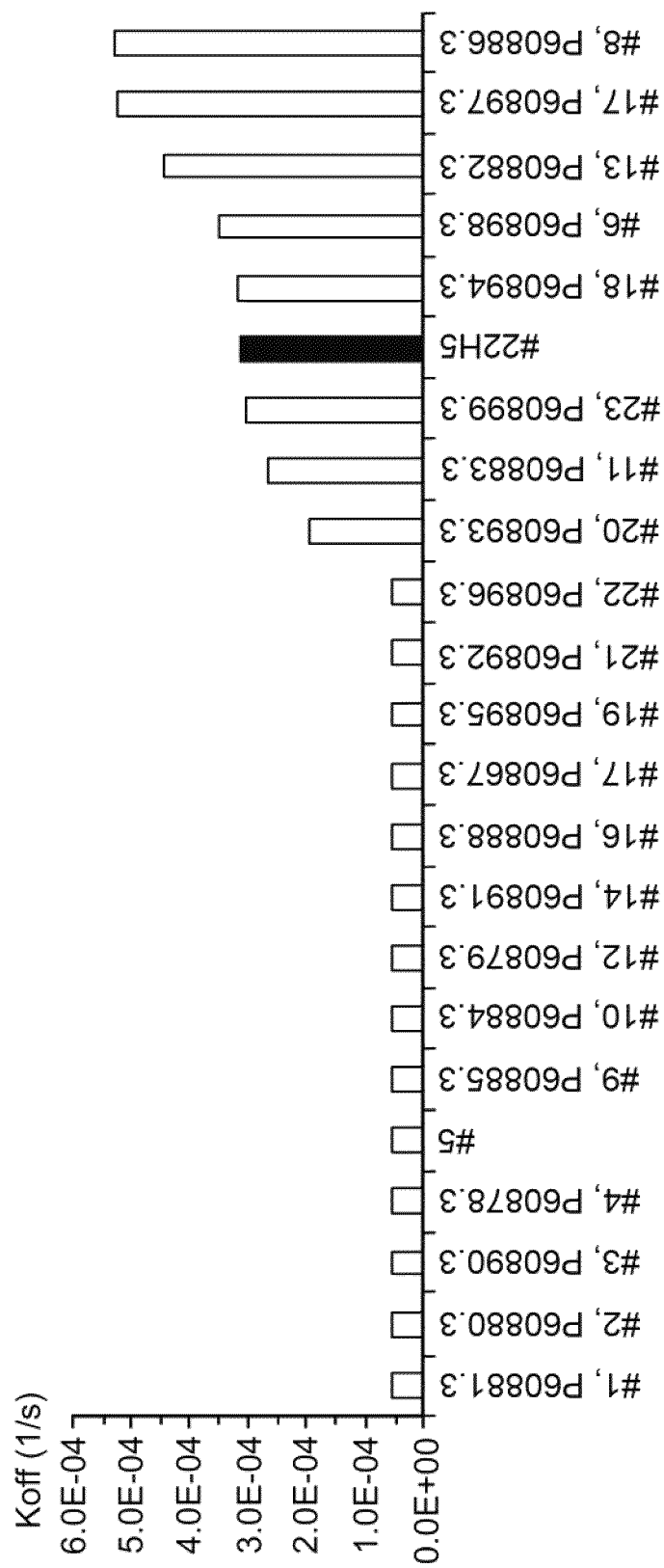
FIG. 33 is a bar graph comparing off-rates for several 22H5 and 17H7 variants that were generated.

Among the engineered mAbs tested, the majority of them showed tight binding to human β-Klotho, except #15 which showed no binding. Table 9 below shows 100 nM mAbs binding to β-Klotho captured on anti-His. FIG. 33 shows the comparison to off-rate.

TABLE 9

Binding to β-Klotho

| Sample | koff (1/s) |
|---|---|
| #20, P60893.3 | 1.9E−04 |
| #11, P60883.3 | 2.6E−04 |
| #23, P60899.2 | 3.0E−04 |
| 22H5 | 3.1E−04 |
| #18, P60894.3 | 3.1E−04 |
| #6, P60898.3 | 3.5E−04 |
| #13, P60882.3 | 4.4E−04 |
| #7, P60897.3 | 5.2E−04 |
| #8, P60886.3 | 5.3E−04 |

Example 15

Combinations of Antigen Binding Proteins Show an Additive Effect

Antigen binding proteins representing different binding bins (FIG. 11a and b) were selected and tested in reporter assays in pairs to determine if the pair of molecules would behave in an additive fashion. Assays were run as follows.

On day one, AM-1/D FGFR1c+β-Klotho Luc clone was seeded in a 96-well plate at 20K cells/well in DMEM+10% FBS medium. The plate was incubated overnight. The following day, the medium was replaced with assay medium (DMEM+0.2% FBS) and incubated overnight. From an antibody working stock (1 mg/mL in PBS), each antibody under study was prepared at a dilution of 2 μg/ml in assay medium. 100 μL of each antibody to be tested was combined in a U-bottom plate. The assay medium was removed from the cells, and 50 μL of the antibody mixtures was transferred to the cells. The antibody mixtures were incubated on the cells for 5 hrs. Lastly, each sample was read-out with SteadyGlo Luciferase reagent (50 μl/well), per the manufacturer's specifications.

Table 10 below is a summary of the activity (% of FGF21 activity from the reporter assay) observed from the study; Table 11 expresses the observed activities with respect to bins.

TABLE 10

Antibody Combination Activity (%)

| | | | Iso | | | | | |
|---|---|---|---|---|---|---|---|---|
| | | IgG2k | 6 2G10 | 5 16H7 | 4 12E4.1 | 3 20D4.1 | 2 39F7 | 1 26H11.1 |
| Iso | IgG2k | ND | −1.1 | 23.5 | 25.4 | 12.5 | 9.2 | 17.9 |
| 1 | 26H11.1 | 17.9 | 19.1 | 36.7 | 21.4 | 28.3 | 20.7 | |
| 2 | 39F7 | 9.2 | 9.1 | 37.0 | 30.8 | 21.4 | | |
| 3 | 20D4.1 | 12.5 | 13.5 | 19.4 | 32.0 | | | |
| 4 | 12E4.1 | 25.4 | 28.8 | 41.5 | | | | |
| 5 | 16H7 | 23.5 | 27.8 | | | | | |
| 6 | 2G10 | −1.1 | | | | | | |

TABLE 11

Antibody Combinations Expressed in Terms of Bins

| Bin | Ab ID | Isotype | D 2G10 | C 39F7 | B 12E4.1 | B 26H11.1 | A 16H7 | A 20D4.1 |
|---|---|---|---|---|---|---|---|---|
| A | 20D4.1 | 12.5 | 13.5 | 21.4 | 32.0 | 28.3 | 19.4 | |
| A | 16H7 | 23.5 | 27.8 | 37.0 | 41.5 | 36.7 | | |
| B | 26H11.1 | 17.9 | 19.1 | 20.7 | 21.4 | | | |
| B | 12E4.1 | 25.4 | 28.8 | 30.8 | | | | |
| C | 39F7 | 9.2 | 9.1 | | | | | |
| D | 2G10 | −1.1 | | | | | | |

Figure 34A:
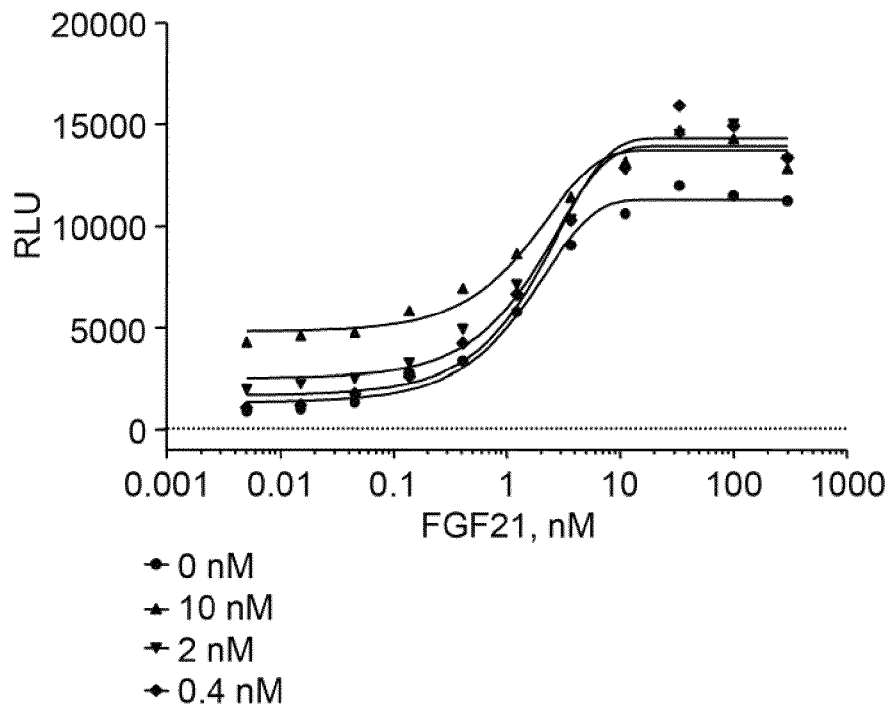
FIGS. 34A-34B are, two plots that depict binding curves for 39F11 when titrated with FGF21 and for FGF21 when titrated with 39F11; the plots demonstrate an additive effect.
Figure 34B:
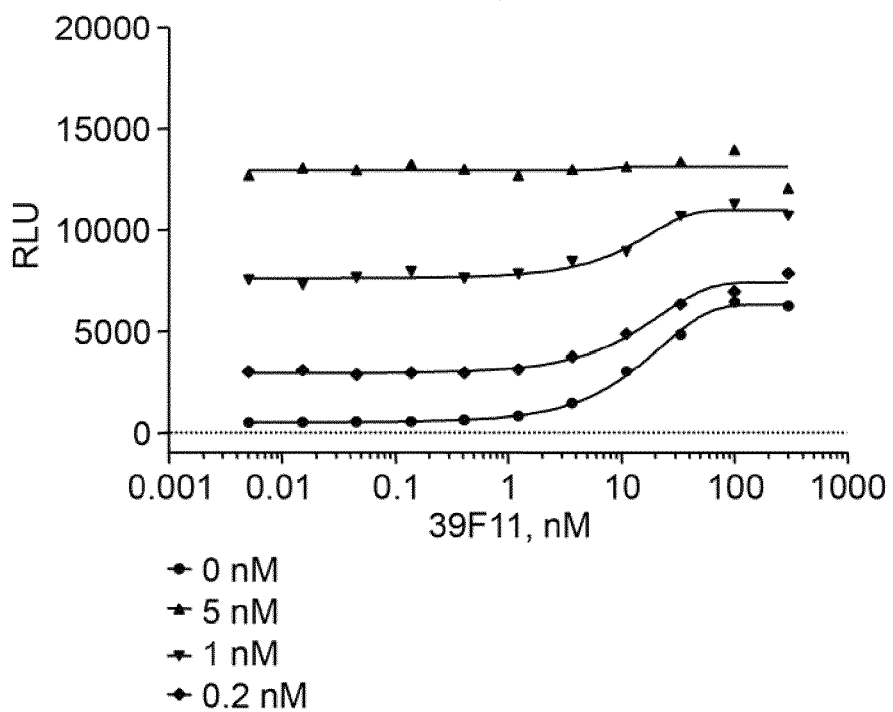
Figure 35A:
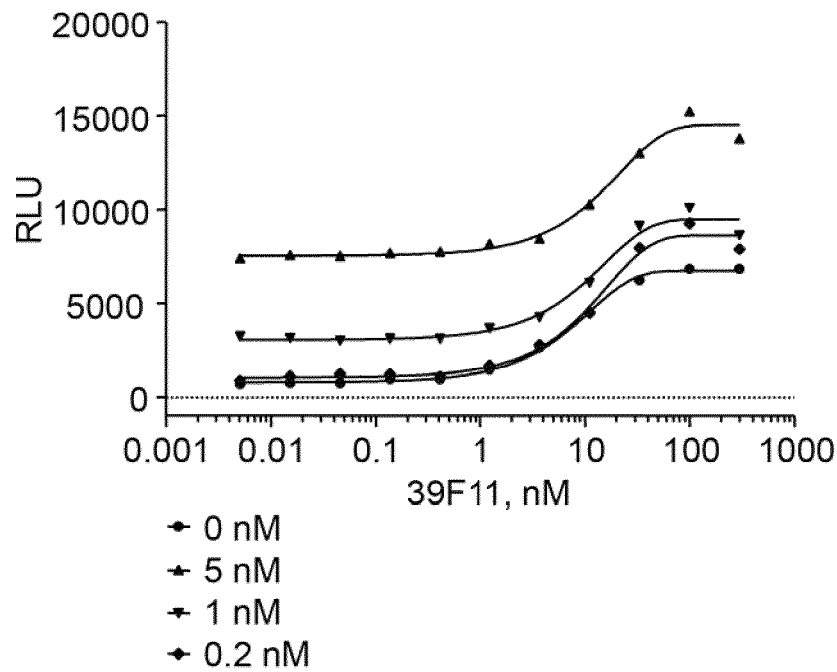
FIGS. 35A-35B are two plots that depict binding curves for 16H7 when titrated with 39F11 and 39F11 when it is titrated with 16H7; the plots demonstrate an additive effect.
Figure 35B:
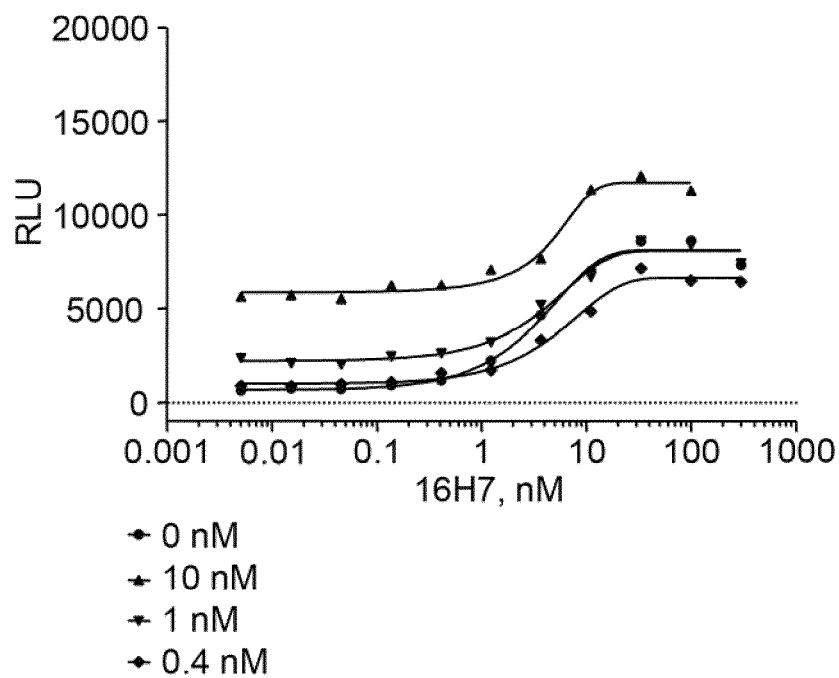

Surprisingly, several pairs of molecules showed an additive effect. As shown in FIGS. 34 and 35, respectively, 39F11 and FGF21 showed an additive effect when measured in the reporter assay of Example 5, as did 16H7 and 39H11.

Summarizing the data from this set of experiments, it was observed that antigen binding proteins from the same binding bin, e.g., 16H7 when paired with 20D4 (both from Group A), the summed activity was not additive. This was also observed when 12E4 was paired with 26H11 (both from Group B). Additionally, paired antigen binding proteins from non-overlapping bins showed additive activities, e.g., 16H7 (Group A) paired with 26H11 or 12E4 (Group B), or paired with 39F7 (Group C). Further, antigen binding proteins 26H11 and 12E4 (Group B) showed additive effect when combined with Abs from Group A but not Group C, suggesting there may be some overlap between the binding sites of Group B and Group C and/or that the activation conformations induced by the antigen binding proteins from Group B and Group C are not mutually compatible. Finally, as expected, when a functional antigen binding protein is paired with a non-functional antigen binding protein (e.g., 2G10) which binds to a distinct and non-overlapping binding site from Group A, B or C, there is no effect upon the activity from the functional antigen binding protein from Group A, B or C.

Collectively, this data suggests that the disclosed antigen binding proteins can be co-administered to enhance the effect that a given antigen binding protein may provide on its own.

Each reference cited herein is incorporated by reference in its entirety for all that it teaches and for all purposes.

The present disclosure is not to be limited in scope by the specific embodiments described herein, which are intended as illustrations of individual aspects of the disclosure, and functionally equivalent methods and components form aspects of the disclosure. Indeed, various modifications of the disclosure, in addition to those shown and described herein will become apparent to those skilled in the art from the foregoing description and accompanying drawings. Such modifications are intended to fall within the scope of the appended claims.

SEQUENCE LISTING (483 sequences)

SEQ ID NO: 1 - DNA, 630 bp, Homo sapiens
atggactcggacgagaccgggttcgagcactcaggactgtgggtttctgtgctggctggtcttctgctgggagcctgccaggcacaccccatccctgactccagtcctctcctgcaattcgggggccaagtccggcagcggtacctctacacagatgatgcccagcagacagaagcccacctggagatcagggaggatgggacggtggggggcgctgctgaccagagccccgaaagtctcctgcagctgaaagccttgaagccgggagttattcaaatcttgggagtcaagacatccaggttcctgtgccagcggccagatggggccctgtatggatcgctccactttgaccctgaggcctgcagcttccgggagctgcttcttgaggacggatacaatgtttaccagtccgaagcccacggcctcccgctgcacctgccagggaacaagtccccacaccgggaccctgcaccccgaggaccagctcgcttcctgccactaccaggcctgccccccgcacccccggagccacccggaatcctggccccccagccccccgatgtgggctcctcggaccctctgagcatggtgggaccttcccagggccgaagccccagctacgcttcctga

SEQ ID NO: 2 - protein, 209 aa, Homo sapiens [sequence omitted]

SEQ ID NO: 3 - DNA, 2469 bp, Homo sapiens
atgtggagctggaagtgcctcctcttctgggctgtgctggtcacagccacactctgcaccgctaggccgtccccgaccttgcctgaacaagcccagccctggggagcccctgtggaagtggagtccttcctggtccaccccggtgacctgctgcagcttcgctgtcggctgcgggacgatgtgcagagcatcaactggctgcgggacggggtgcagctggcggaaagcaaccgcacccgcatcacaggggaggaggtggaggtgcaggactccgtgcccgcagactccggcctctatgcttgcgtaaccagcagcccctcgggcagtgacaccacctacttctccgtcaatgtttcagatgctctcccctcctcggaggatgatgatgatgatgatgactcctcttcagaggagaaagaaacagataacaccaaaccaaaccgtatgcccgtagctccatattggacatcaccagaaaagatggaaaagaaattgcatgcagtgccggctgccaagacagtgaagttcaaatgcccttccagtgggacaccaaacccaacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggccggcagtgatgacctcgcccctgtacctggagatcatcatctattgcacaggggccttcctcatctcctgcatggtggggtcggtcatcgtctacaagatgaagagtggtaccaagaagagtgacttccacagccagatggctgtgcacaagctggccaagagcatccctctgcgcagacaggtaacagtgtctgctgactccagtgcatccatgaactctggggttcttctggttcggccatcacggctctcctccagtgggactcccatgctagcaggggtctctgagtatgagcttcccgaagaccctcgctgggagctgcctcgggacagactggtcttaggcaaacccctgggagagggctgctttgggcaggtggtgttggcagaggctatcgggctggacaaggacaaacccaaccgtgtgaccaaagtggctgtgaagatgttgaagtcggacgcaacagagaaagacttgtcagacctgatctcagaaatggagatgatgaagatgatcgggaagcataagaatatcatcaacctgctgggggcctgcacgcaggatggtcccttgtatgtcatcgtggagtatgcctccaagggcaacctgcgggagtacctgcaggcccggaggcccccagggctggaatactgctacaaccccagccacaacccagaggagcagctctcctccaaggacctggtgtcctgcgcctaccaggtggcccgaggcatggagtatctggcctccaagaagtgcatacaccgagacctggcagccaggaatgtcctggtgacagaggacaatgtgatgaagatagcagactttggcctcgcacgggacattcaccacatcgactactataaaaagacaaccaacggccgactgcctgtgaagtggatggcacccgaggcattatttgaccggatctacacccaccagagtgatgtgtggtctttcggggtgctcctgtgggagatcttcactctgggcggctccccataccccggtgtgcctgtggaggaacttttcaagctgctgaaggagggtcaccgcatggacaagcccagtaactgcaccaacgagctgtacatgatgatgcgggactgctggcatgcagtgccctcacagagacccaccttcaagcagctggtggaagacctggaccgcatcgtggccttgacctccaaccaggagtacctggacctgtccatgcccctggaccagtactcccccagctttcccgacacccggagctctacgtgctcctcaggggaggattccgtcttctctcatgagccgctgcccgaggagccctgcctgccccgacacccagcccagcttgccaatggcggactcaaacgccgctga

SEQ ID NO: 4 - protein, 822 aa, Homo sapiens [sequence omitted]

SEQ ID NO: 5 - protein, 374 aa, Homo sapiens
MWSWKCLLFWAVLVTATLCTARPSPTLPEQAQPWGAPVEVESFLVHPGDLLQLRCRLRDDVQSINWLRDGVQLAESNRTRITGEEVEVQDSVPADSGLYACVTSSPSGSDTTYFSVNVSDALPSSEDDDDDDDSSSEEKETDNTKPNRMPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERPAVMTSPLY

SEQ ID NO: 6 - DNA, 3135 bp, Homo sapiens
atgaagccaggctgtgcggcaggatctccagggaatgaatggattttcttcagcactgatgaaataaccacacgctataggaatacaatgtccaacgggggattgcaaagatctgtcatcctgtcagcacttattctgctacgagctgttactggattctctggagatggaagagctatatggtctaaaaatcctaattttactccggtaaatgaaagtcagctgtttctctatgacactttccctaaaaactttttctggggtattgggactggagcattgcaagtggaagggagttggaagaaggatggaaaaggaccttctatatgggatcatttcatccacacacaccttaaaaatgtcagcagcacgaatggttccagtgacagttatatttttctggaaaaagacttatcagccctggattttataggagtttctttttatcaattttcaatttcctggccaaggcttttccccgatggaatagtaacagttgccaacgcaaaaggtctgcagtactacagtactcttctggacgctctagtgcttagaaacattgaacctatagttactttataccactgggatttgcctttggcactacaagaaaaatatggggggtggaaaaatgataccataatagatatcttcaatgactatgccacatactgtttccagatgtttggggaccgtgtcaaatattggattacaattcacaacccatatctagtggcttggcatgggtatgggacaggtatgcatgcccctggagagaagggaaatttagcagctgtctacactgtgggacacaacttgatcaaggctcactcgaaagtttggcataactacaacacacatttccgcccacatcagaagggttggttatcgatcacgttgggatctcattggatcgagccaaaccggtcggaaaacacgatggatatattcaaatgtcaacaatccatggtttctgtgcttggatggtttgccaaccctatccatggggatggcgactatccagaggggatgagaaagaagttgttctccgttctacccattttctctgaagcagagaagcatgagatgagaggcacagctgatttctttgccttttcttttggacccaacaacttcaagcccctaaacaccatggctaaaatgggacaaaatgtttcacttaatttaagagaagcgctgaactggattaaactggaatacaacaaccctcgaatcttgattgctgagaatggctggttcacagacagtcgtgtgaaaacagaagacaccacggccatctacatgatgaagaatttcctcagccaggtgcttcaagcaataaggttagatgaaatacgagtgtttggttatactgcctggtctctcctggatggctttgaatggcaggatgcttacaccatccgccgaggattattttatgtggattttaacagtaaacagaaagagcggaaacctaagtcttcagcacactactacaaacagatcatacgagaaaatggtttttctttaaaagagtccacgccagatgtgcagggccagtttccctgtgacttctcctggggtgtcactgaatctgttcttaagcccgagtctgtggcttcgtccccacagttcagcgatcctcatctgtacgtgtggaacgccactggcaacagactgttgcaccgagtggaaggggtgaggctgaaaacacgacccgctcaatgcacagattttgtaaacatcaaaaaacaacttgagatgttggcaagaatgaaagtcacccactaccggtttgctctggattgggcctcggtccttcccactggcaacctgtccgcggtgaaccgacaggccctgaggtactacaggtgcgtggtcagtgaggggctgaagcttggcatctccgcgatggtcaccctgtattatccgacccacgcccacctaggcctccccgagcctctgttgcatgccgacgggtggctgaacccatcgacggccgaggccttccaggcctacgctgggctgtgcttccaggagctgggggacctggtgaagctctggatcaccatcaacgagcctaaccggctaagtgacatctacaaccgctctggcaacgacacctacggggcggcgcacaacctgctggtggcccacgccctggcctggcgcctctacgaccggcagttcaggccctcacagcgcggggccgtgtcgctgtcgctgcacgcggactgggcggaacccgccaacccctatgctgactcgcactggagggcggccgagcgcttcctgcagttcgagatcgcctggttcgccgagccgctcttcaagaccggggactaccccgcggccatgagggaatacattgcctccaagcaccgacgggggctttccagctcggccctgccgcgcctcaccgaggccgaaaggaggctgctcaagggcacggtcgacttctgcgcgctcaaccacttcaccactaggttcgtgatgcacgagcagctggccggcagccgctacgactcggacagggacatccagtttctgcaggacatcacccgcctgagctcccccacgcgcctggctgtgattccctggggggtgcgcaagctgctgcggtgggtccggaggaactacggcgacatggacatttacatcaccgccagtggcatcgacgaccaggctctggaggatgaccggctccggaagtactacctagggaagtaccttcaggaggtgctgaaagcatacctgattgataaagtcagaatcaaaggctattatgcattcaaactggctgaagagaaatctaaacccagatttggattcttcacatctgattttaaagctaaatcctcaatacaattttacaacaaagtgatcagcagcaggggcttcccttttgagaacagtagttctagatgcagtcagacccaagaaaatacagagtgcactgtctgcttattccttgtgcagaagaaaccactgatattcctgggttgttgcttcttctccaccctggttctactcttatcaattgccatttttcaaaggcagaagagaagaaagttttggaaagcaaaaaacttacaacacataccattaaagaaaggcaagagagttgttagctaa

SEQ ID NO: 7 - protein, 1044 aa, Homo sapiens
MKPGCAAGSPGNEWIFFSTDEITTRYRNTMSNGGLQRSVILSALILLRAVTGFSGDGRAIWSKNPNFTPVNESQLFLYDTFPKNFFWGIGTGALQVEGSWKKDGKGPSIWDHFIHTHLKNVSSTNGSSDSYIFLEKDLSALDFIGVSFYQFSISWPRLFPDGIVTVANAKGLQYYSTLLDALVLRNIEPIVTLYHWDLPLALQEKYGGWKNDTIIDIFNDYATYCFQMFGDRVKYWITIHNPYLVAWHGYGTGMHAPGEKGNLAAVYTVGHNLIKAHSKVWHNYNTHFRPHQKGWLSITLGSHWIEPNRSENTMDIFKCQQSMVSVLGWFANPIHGDGDYPEGMRKKLFSVLPIFSEAEKHEMRGTADFFAFSFGPNNFKPLNTMAKMGQNVSLNLREALNWIKLEYNNPRILIAENGWFTDSRVKTEDTTAIYMMKNFLSQVLQAIRLDEIRVFGYTAWSLLDGFEWQDAYTIRRGLFYVDFNSKQKERKPKSSAHYYKQIIRENGFSLKESTPDVQGQFPCDFSWGVTESVLKPESVASSPQFSDPHLYVWNATGNRLLHRVEGVRLKTRPAQCTDFVNIKKQLEMLARMKVTHYRFALDWASVLPTGNLSAVNRQALRYYRCVVSEGLKLGISAMVTLYYPTHAHLGLPEPLLHADGWLNPSTAEAFQAYAGLCFQELGDLVKLWITINEPNRLSDIYNRSGNDTYGAAHNLLVAHALAWRLYDRQFRPSQRGAVSLSLHADWAEPANPYADSHWRAAERFLQFEIAWFAEPLFKTGDYPAAMREYIASKHRRGLSSSALPRLTEAERRLLKGTVDFCALNHFTTRFVMHEQLAGSRYDSDRDIQFLQDITRLSSPTRLAVIPWGVRKLLRWVRRNYGDMDIYITASGIDDQALEDDRLRKYYLGKYLQEVLKAYLIDKVRIKGYYAFKLAEEKSKPRFGFFTSDFKAKSSIQFYNKVISSRGFPFENSSSRCSQTQENTECTVCLFLVQKKPLIFLGCCFFSTLVLLLSIAIFQRQKRRKFWKAKNLQHIPLKKGKRVVS

SEQ ID NO: 8 - protein, 996 aa, Homo sapiens
MKPGCAAGSPGNEWIFFSTDEITTRYRNTMSNGGLQRSVILSALILLRAVTGFSGDGRAIWSKNPNFTPVNESQLFLYDTFPKNFFWGIGTGALQVEGSWKKDGKGPSIWDHFIHTHLKNVSSTNGSSDSYIFLEKDLSALDFIGVSFYQFSISWPRLFPDGIVTVANAKGLQYYSTLLDALVLRNIEPIVTLYHWDLPLALQEKYGGWKNDTIIDIFNDYATYCFQMFGDRVKYWITIHNPYLVAWHGYGTGMHAPGEKGNLAAVYTVGHNLIKAHSKVWHNYNTHFRPHQKGWLSITLGSHWIEPNRSENTMDIFKCQQSMVSVLGWFANPIHGDGDYPEGMRKKLFSVLPIFSEAEKHEMRGTADFFAFSFGPNNFKPLNTMAKMGQNVSLNLREALNWIKLEYNNPRILIAENGWFTDSRVKTEDTTAIYMMKNFLSQVLQAIRLDEIRVFGYTAWSLLDGFEWQDAYTIRRGLFYVDFNSKQKERKPKSSAHYYKQIIRENGFSLKESTPDVQGQFPCDFSWGVTESVLKPESVASSPQFSDPHLYVWNATGNRLLHRVEGVRLKTRPAQCTDFVNIKKQLEMLARMKVTHYRFALDWASVLPTGNLSAVNRQALRYYRCVVSEGLKLGISAMVTLYYPTHAHLGLPEPLLHADGWLNPSTAEAFQAYAGLCFQELGDLVKLWITINEPNRLSDIYNRSGNDTYGAAHNLLVAHALAWRLYDRQFRPSQRGAVSLSLHADWAEPANPYADSHWRAAERFLQFEIAWFAEPLFKTGDYPAAMREYIASKHRRGLSSSALPRLTEAERRLLKGTVDFCALNHFTTRFVMHEQLAGSRYDSDRDIQFLQDITRLSSPTRLAVIPWGVRKLLRWVRRNYGDMDIYITASGIDDQALEDDRLRKYYLGKYLQEVLKAYLIDKVRIKGYYAFKLAEEKSKPRFGFFTSDFKAKSSIQFYNKVISSRGFPFENSSSRCSQTQENTECTVCLFLVQKKP

SEQ ID NO: 9 - protein, 326 aa, Homo sapiens
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 10 - protein, 107 aa, Homo sapiens [sequence omitted]

SEQ ID NO: 11 - protein, 106 aa, Homo sapiens
GQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 12 - protein, 214 aa, Artificial Sequence
  Description of Artificial Sequence: Synthetic polypeptide
SYVLTQPPSVSVAPGQTARITCGGNNIGSQSVHWYQQKPGQAPVLVVYDDSDRPSGIPERFSGSNSGNTATLTISRVEAGDEADYYCQVWDSSSDHVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 13 - protein, 214 aa, Artificial Sequence
  Description of Artificial Sequence: Synthetic polypeptide
SYVLTQPPSVSVAPGQTARITCGGNNIGSQSVHWYQQKPGQAPVLVVYDDSDRPSGIPERFSGSNSGNTATLTISRVEAGDEADYYCQVWDNTSDHVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 14 - protein, 214 aa, Artificial Sequence
  Description of Artificial Sequence: Synthetic polypeptide
SYVLTQPPSVSVAPGQTARITCGGNNIGSESVHWYQQKPGQAPVLVVYDDSDRPSGIPERFSGSNSGNTATLTISRVEAGDEADYYCQVWDGNSDHVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 15 - protein, 215 aa, Artificial Sequence
  Description of Artificial Sequence: Synthetic polypeptide
EIVLTQSPGTLSLSPGERATLSCRASQNFDSSYLAWYQQKPGQAPRLLIYGTSSRATGIPDRFSGIGSGTDFTLTINRLEPEDFAMYYCQQYGGSPLTFGGGTEVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 16 - protein, 215 aa, Artificial Sequence
  Description of Artificial Sequence: Synthetic polypeptide
EIVLTQSPGTLSLSPGERATLSCRASQSVSGNYLAWYQQKPGQAPRLLIYGASSRATGIPDRFSGSGSGTDFTLTISRLEPEDFAVYYCQQYGSAPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 17 - protein, 215 aa, Artificial Sequence
  Description of Artificial Sequence: Synthetic polypeptide
EIVLTQSPGTLSLSPGERATLSCRASQSVSGNYLAWYQQKPGQAPRLLIYGASSRATGIPDRFSGSGSGTDFTLTISRLEPEDFAMYYCQQYGSSPLTFGGGSKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 18 - protein, 215 aa, Artificial Sequence
  Description of Artificial Sequence: Synthetic polypeptide
EIVLTQSPGTLSLSPGERATLSCRASQNFDSNYLAWYQQKPGQAPRLLIYGASSRATGIPDNFSGSGSGTDFTLTISRLEPEDFAMYYCQQYGSSPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19 - protein, 215 aa, Artificial Sequence
  Description of Artificial Sequence: Synthetic polypeptide
EIVLTQSPGTLSLSPGERATLSCRASQNFDSSSLAWYQQKPGQAPRLLIYGASSRATGIPDRFSGSGSGTDFTLTISRLEPEDFAMYYCQQCGSSPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 20 - protein, 214 aa, Artificial Sequence
  Description of Artificial Sequence: Synthetic polypeptide
EIVLTQSPGTLSLSPGERATLSCRASQSVSSTYLAWHQQKPGQGLRLLIYGASSRATGIPDRFSGSGSGTDFTLTISRLEPEDFAVYYCQQYGSSFTFGGGTRVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 21 - protein, 219 aa, Artificial Sequence
  Description of Artificial Sequence: Synthetic polypeptide
DIVMTQSPLSLPVTPGEPASISCRSSQSLLYYNGFTYLDWFLQKPGQSPHLLIYLGSNRASGVPDRFSGSVSGTDFTLKISRVEAEDVGVYYCMQSLQTPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 22 - protein, 214 aa, Artificial Sequence
  Description of Artificial Sequence: Synthetic polypeptide
EIVMTQSPATLSVSPGERATLSCRASQSVNSNLAWYQQKPGQAPRLLIYGVSTRATGIPARFSGSGSGTEFTLTIRSLQSEDFAVYYCQQYNNWPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 23 - protein, 214 aa, Artificial Sequence
  Description of Artificial Sequence: Synthetic polypeptide
DIQLTQSPSSLSASIGDRVTITCRASQDIRYDLGWYQQKPGKAPKRLIYAASSLQSGVPSRFSGSGSGTEFTLTVSSLQPEDFATYYCLQHNSYPLTFGGGTKVEIERTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 24 - protein, 214 aa, Artificial Sequence
  Description of Artificial Sequence: Synthetic polypeptide
DIQMTQSPSSVSASVGDRVTITCRASQGISIWLAWYQQKPGKAPKLLIYAASSLQSGVPSRFSGSGSGTDFTLTISSLQPEDFATYYCQQANDFPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 25 - protein, 219 aa, Artificial Sequence
  Description of Artificial Sequence: Synthetic polypeptide
DFVMTQTPLSLSVTPGQPASISCKSSQSLLQSDGKTYLYWYLQKPGQPPHLLIYEVSNRFSGVPDRFSGSGSGTDFTLKISRVEAEDVGVYYCMQSIQLPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26 - protein, 219 aa, Artificial Sequence
  Description of Artificial Sequence: Synthetic polypeptide
DIVMTQSPLSLPVTPGEPASISCRSSQSLLHSNGYNFLDWYLQKPGQSPQLLIYLGSDRASGVPDRFSGSGSGTEFTLKISRVEAEDVGLYYCMQALQTPCSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 27 - protein, 215 aa, Artificial Sequence
  Description of Artificial Sequence: Synthetic polypeptide
EIVLTQSPGTLSLSPGERATLSCRASQSVSSTYLAWYQQKPGQAPRLLIYGASSRATGIPDRFSGSGSGTDFTLTISRLEPEDFAVYYCQQSGSSPLTFGGGTEVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 28 - protein, 215 aa, Artificial Sequence
  Description of Artificial Sequence: Synthetic polypeptide
EIVLTQSPGTLSLSPGERATLSCRASQSVSSTYLAWYQQKPGQAPSLLIYGASSRATGIPDRFSGSGSGTDFTLTISRLEPEDFAVYYCQQSGSSPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 29 - protein, 215 aa, Artificial Sequence
  Description of Artificial Sequence: Synthetic polypeptide
EIVLTQSPGTLSLSPGERATLSCRASQSVSSTYLAWYQQKPGQAPRLLIYGASFRATGIPDRFSGSGSGTDFTLTISRLEPEDFAVYYCQQSGSSPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 30 - protein, 450 aa, Artificial Sequence
  Description of Artificial Sequence: Synthetic polypeptide
QVTLKESGPVLVKPTETLTLTCTVSGFSLSNARMGVSWIRQPPGKALEWLAHIFSNDEKSYSTSLKSRLTISKDTSKSQVVLTMTNMDPVDTATYYCARILLLGAYYYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 31 - protein, 450 aa, Artificial Sequence
  Description of Artificial Sequence: Synthetic polypeptide
QVTLKESGPVLVKPTETLTLTCTVSGFSLSNARMGVSWIRQPPGKALEWLAHIFSNDEKSYSTSLKSRLTISKDTSKSQVVLTMTNMDPVDTATYYCARILLVGAYYYCGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 32 - protein, 450 aa, Artificial Sequence
  Description of Artificial Sequence: Synthetic polypeptide
QVTLKESGPVLVKPTETLTLTCTVSGFSLNNARMGVSWIRQPPGKALEWLAHIFSNDEKSYSTSLKSRLTISKDTSKSQVVLIMTNMDPVDTATYYCARSVVTGGYYYDGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 33 - protein, 450 aa, Artificial Sequence
  Description of Artificial Sequence: Synthetic polypeptide
QVTLKESGPVLVKPTETLTLTCTVSGFSLSNARMGVSWIRQPPGKALEWLAHIFSNDEKSYSTSLKNRLTISKDTSKSQVVLIMTNMDPVDTATYYCARSVVTGGYYYDGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 34 - protein, 447 aa, Artificial Sequence
  Description of Artificial Sequence: Synthetic polypeptide
EVQLLESGGGLVQPGGSLRLSCAASRFTFSTYAMSWVRQAPGKGLEWVSGISGSGVSTHYADSVKGRFTISRDNSKNTLYLQMNSLRAEDTAVYYCAKSLIVVIVYALDHWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 35 - protein, 447 aa, Artificial Sequence
  Description of Artificial Sequence: Synthetic polypeptide
EVQLLESGGGLVQPGGYLRLSCAASGFTFSTYAMSWVRQAPGKGLEWVSAISGSGVSTYYADSVKGRFTISRDNSKNTLYLQMNSLRAEDTAVYYCAKSLIVVMVYVLDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 36 - protein, 447 aa, Artificial Sequence
  Description of Artificial Sequence: Synthetic polypeptide
EVQLLESGGGLVQPGGYLRLSCAASGFTFSTYAMSWVRQAPGKGLEWVSAISGSGVSTNYADSVKGRFTISRDNSKNTLYLQMNSLRAEDTAVYYCAKSLIVVMVYVLDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 37 - protein, 447 aa, Artificial Sequence
  Description of Artificial Sequence: Synthetic polypeptide
EVQLLESGGGLVQPGGSLRLSCAASRFTFSTYAMSWVRQAPGKGLEWVSGISGSGVSTYYADSVKGRFTISRDNSKNTLYLQMNSLRAEDTAVYYCAKSLIVVIVYALDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 38 - protein, 447 aa, Artificial Sequence
  Description of Artificial Sequence: Synthetic polypeptide
QVQLQESGPGLVKPSETLSLTCTVSGGSISSYYWSWIRQPAGKGLEWIGRIYTSGSTNYNPSLKSRVTMSKDTSKNQFSLKLRSVTAADTAVYYCARDPDGDYYYYGMDVWGQGTSVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 39 - protein, 447 aa, Artificial Sequence
  Description of Artificial Sequence: Synthetic polypeptide
QVQLQESGPGLVKPSETLSLTCTVSGGSISSYFWSWIRQPAGKGLEWIGRIYTSGSTNYNPSLKSRVTMSIDTSKNQFSLKLSSVTAADTAVYYCARDPDGDYYYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 40 - protein, 453 aa, Artificial Sequence
  Description of Artificial Sequence: Synthetic polypeptide
EVQLVESGGGLVKPGGSLRLSCAASGFTFSDAWMSWVRQAPGKGLEWVGRIKSKTDGGTTDYAAPVKGRFTISRDDSKNTLYLQMNSLKTEDTAVYFCTSTYSSGWYVWDYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 41 - protein, 454 aa, Artificial Sequence
  Description of Artificial Sequence: Synthetic polypeptide
QVQLVQSGAEVKKPGASVKVSCKVSGYTLTDLSMHWVRQAPGKGLEWMGGFDPEDGETIYAQKFQGRITMTEDTSTDTAYMELSSLRSEDTAVYYCASIVVVPAAIQSYYYYYGMGVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 42 - protein, 451 aa, Artificial Sequence
  Description of Artificial Sequence: Synthetic polypeptide
QVTLKEAGPVLVKPTETLTLTCTVSGFSLSNARMGVNWIRQPPGKALEWLAHIFSNDEKSYSTSLKSRLTISKDTSKSQVVLTMTNMDPVDTATYYCARVRIAGDYYYYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 43 - protein, 450 aa, Artificial Sequence
  Description of Artificial Sequence: Synthetic polypeptide
QVQLVESGGGVVQPGRSLRLSCAASGFTFSSYGIHWVRQAPGKGLEWVAVIWYDGSDKYYADSVKGRFTISRDNSKNTLYLQMNSLRAEDTAVYYCARDRAAAGLHYYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 44 - protein, 450 aa, Artificial Sequence
  Description of Artificial Sequence: Synthetic polypeptide
QVQLVESGGGVVQPGRSLRLSCAASGFTFSNYGIHWVRQAPGKGLEWVAVIWYDGSIKYYADSVKGRFTISRDNSKNTLYLQMNSLRAEDTAVYYCARDRAAAGLHYYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 45 - protein, 450 aa, Artificial Sequence
  Description of Artificial Sequence: Synthetic polypeptide
QVQLVESGGGVVQPGRSLRLSCAVSGFTFSSYGIHWVRQAPGKGLEWVAVIWYDGSDKYYGDSVKGRFTISRDNSKNTLYLQMNSLRAEDTAVYYCARDRAAAGLHYYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 46 - protein, 453 aa, Artificial Sequence
  Description of Artificial Sequence: Synthetic polypeptide
QVQLQESGPGLVKPSQTLSLTCTVSGGSISSGGYNWSWIRQHPGKGLEWIGNIYYSGSTYYNPSLKSRVTISVDTSKNQFSLKLRSVTAADTAVYYCARENIVVIPAAIFAGWFDPWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 47 - protein, 448 aa, Artificial Sequence
  Description of Artificial Sequence: Synthetic polypeptide
EVHLVESGGGLAKPGGSLRLSCAASGFTFRNAWMSWVRQAPGKGLEWVGRIKSKTDGGTTDYAAPVKGRFTISRDDSKNTLYLQMNSLKTEDTAEYYCITDRVLSYYAMAVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 48 - protein, 108 aa, Artificial Sequence
  Description of Artificial Sequence: Synthetic polypeptide
SYVLTQPPSVSVAPGQTARITCGGNNIGSQSVHWYQQKPGQAPVLVVYDDSDRPSGIPERFSGSNSGNTATLTISRVEAGDEADYYCQVWDSSSDHVVFGGGTKLTVL

SEQ ID NO: 49 - protein, 108 aa, Artificial Sequence
  Description of Artificial Sequence: Synthetic polypeptide
SYVLTQPPSVSVAPGQTARITCGGNNIGSQSVHWYQQKPGQAPVLVVYDDSDRPSGIPERFSGSNSGNTATLTISRVEAGDEADYYCQVWDNTSDHVVFGGGTKLTVL

SEQ ID NO: 50 - protein, 108 aa, Artificial Sequence
  Description of Artificial Sequence: Synthetic polypeptide
SYVLTQPPSVSVAPGQTARITCGGNNIGSESVHWYQQKPGQAPVLVVYDDSDRPSGIPERFSGSNSGNTATLTISRVEAGDEADYYCQVWDGNSDHVVFGGGTKLTVL

SEQ ID NO: 51 - protein, 108 aa, Artificial Sequence
  Description of Artificial Sequence: Synthetic polypeptide
EIVLTQSPGTLSLSPGERATLSCRASQNFDSSYLAWYQQKPGQAPRLLIYGTSSRATGIPDRFSGIGSGTDFTLTINRLEPEDFAMYYCQQYGGSPLTFGGGTEVEIK

SEQ ID NO: 52 - protein, 108 aa, Artificial Sequence
  Description of Artificial Sequence: Synthetic polypeptide
EIVLTQSPGTLSLSPGERATLSCRASQSVSGNYLAWYQQKPGQAPRLLIYGASSRATGIPDRFSGSGSGTDFTLTISRLEPEDFAVYYCQQYGSAPLTFGGGTKVEIK

SEQ ID NO: 53 - protein, 108 aa, Artificial Sequence
  Description of Artificial Sequence: Synthetic polypeptide
EIVLTQSPGTLSLSPGERATLSCRASQSVSGNYLAWYQQKPGQAPRLLIYGASSRATGIPDRFSGSGSGTDFTLTISRLEPEDFAMYYCQQYGSSPLTFGGGSKVEIK

SEQ ID NO: 54 - protein, 108 aa, Artificial Sequence
  Description of Artificial Sequence: Synthetic polypeptide
EIVLTQSPGTLSLSPGERATLSCRASQNFDSNYLAWYQQKPGQAPRLLIYGASSRATGIPDNFSGSGSGTDFTLTISRLEPEDFAMYYCQQYGSSPLTFGGGTKVEIK

SEQ ID NO: 55 - protein, 108 aa, Artificial Sequence
  Description of Artificial Sequence: Synthetic polypeptide
EIVLTQSPGTLSLSPGERATLSCRASQNFDSSSLAWYQQKPGQAPRLLIYGASSRATGIPDRFSGSGSGTDFTLTISRLEPEDFAMYYCQQCGSSPLTFGGGTKVEIK

SEQ ID NO: 56 - protein, 107 aa, Artificial Sequence
  Description of Artificial Sequence: Synthetic polypeptide
EIVLTQSPGTLSLSPGERATLSCRASQSVSSTYLAWHQQKPGQGLRLLIYGASSRATGIPDRFSGSGSGTDFTLTISRLEPEDFAVYYCQQYGSSFTFGGGTRVEIK

SEQ ID NO: 57 - protein, 112 aa, Artificial Sequence
  Description of Artificial Sequence: Synthetic polypeptide
DIVMTQSPLSLPVTPGEPASISCRSSQSLLYYNGFTYLDWFLQKPGQSPHLLIYLGSNRASGVPDRFSGSVSGTDFTLKISRVEAEDVGVYYCMQSLQTPFTFGPGTKVDIK

SEQ ID NO: 58 - protein, 107 aa, Artificial Sequence
  Description of Artificial Sequence: Synthetic polypeptide
EIVMTQSPATLSVSPGERATLSCRASQSVNSNLAWYQQKPGQAPRLLIYGVSTRATGIPARFSGSGSGTEFTLTIRSLQSEDFAVYYCQQYNNWPPTFGQGTKVEIK

SEQ ID NO: 59 - protein, 107 aa, Artificial Sequence
  Description of Artificial Sequence: Synthetic polypeptide
DIQLTQSPSSLSASIGDRVTITCRASQDIRYDLGWYQQKPGKAPKRLIYAASSLQSGVPSRFSGSGSGTEFTLTVSSLQPEDFATYYCLQHNSYPLTFGGGTKVEIE

SEQ ID NO: 60 - protein, 107 aa, Artificial Sequence
  Description of Artificial Sequence: Synthetic polypeptide
DIQMTQSPSSVSASVGDRVTITCRASQGISIWLAWYQQKPGKAPKLLIYAASSLQSGVPSRFSGSGSGTDFTLTISSLQPEDFATYYCQQANDFPITFGQGTRLEIK

SEQ ID NO: 61 - protein, 112 aa, Artificial Sequence
  Description of Artificial Sequence: Synthetic polypeptide
DFVMTQTPLSLSVTPGQPASISCKSSQSLLQSDGKTYLYWYLQKPGQPPHLLIYEVSNRFSGVPDRFSGSGSGTDFTLKISRVEAEDVGVYYCMQSIQLPRTFGQGTKVEIK

SEQ ID NO: 62 - protein, 112 aa, Artificial Sequence
  Description of Artificial Sequence: Synthetic polypeptide
DIVMTQSPLSLPVTPGEPASISCRSSQSLLHSNGYNFLDWYLQKPGQSPQLLIYLGSDRASGVPDRFSGSGSGTEFTLKISRVEAEDVGLYYCMQALQTPCSFGQGTKLEIK

SEQ ID NO: 63 - protein, 108 aa, Artificial Sequence
  Description of Artificial Sequence: Synthetic polypeptide
EIVLTQSPGTLSLSPGERATLSCRASQSVSSTYLAWYQQKPGQAPRLLIYGASSRATGIPDRFSGSGSGTDFTLTISRLEPEDFAVYYCQQSGSSPLTFGGGTEVEIK

SEQ ID NO: 64 - protein, 108 aa, Artificial Sequence
  Description of Artificial Sequence: Synthetic polypeptide
EIVLTQSPGTLSLSPGERATLSCRASQSVSSTYLAWYQQKPGQAPSLLIYGASSRATGIPDRFSGSGSGTDFTLTISRLEPEDFAVYYCQQSGSSPLTFGGGTKVEIK

SEQ ID NO: 65 - protein, 108 aa, Artificial Sequence
  Description of Artificial Sequence: Synthetic polypeptide
EIVLTQSPGTLSLSPGERATLSCRASQSVSSTYLAWYQQKPGQAPRLLIYGASFRATGIPDRFSGSGSGTDFTLTISRLEPEDFAVYYCQQSGSSPLTFGGGTKVEIK

SEQ ID NO: 66 - protein, 124 aa, Artificial Sequence
  Description of Artificial Sequence: Synthetic polypeptide
QVTLKESGPVLVKPTETLTLTCTVSGFSLSNARMGVSWIRQPPGKALEWLAHIFSNDEKSYSTSLKSRLTISKDTSKSQVVLTMTNMDPVDTATYYCARILLLGAYYYYGMDVWGQGTTVTVSS

SEQ ID NO: 67 - protein, 124 aa, Artificial Sequence
  Description of Artificial Sequence: Synthetic polypeptide
QVTLKESGPVLVKPTETLTLTCTVSGFSLSNARMGVSWIRQPPGKALEWLAHIFSNDEKSYSTSLKSRLTISKDTSKSQVVLTMTNMDPVDTATYYCARILLVGAYYYCGMDVWGQGTTVTVSS

SEQ ID NO: 68 - protein, 124 aa, Artificial Sequence
  Description of Artificial Sequence: Synthetic polypeptide
QVTLKESGPVLVKPTETLTLTCTVSGFSLNNARMGVSWIRQPPGKALEWLAHIFSNDEKSYSTSLKSRLTISKDTSKSQVVLIMTNMDPVDTATYYCARSVVTGGYYYDGMDVWGQGTTVTVSS

SEQ ID NO: 69 - protein, 124 aa, Artificial Sequence
  Description of Artificial Sequence: Synthetic polypeptide
QVTLKESGPVLVKPTETLTLTCTVSGFSLSNARMGVSWIRQPPGKALEWLAHIFSNDEKSYSTSLKNRLTISKDTSKSQVVLIMTNMDPVDTATYYCARSVVTGGYYYDGMDVWGQGTTVTVSS

SEQ ID NO: 70 - protein, 121 aa, Artificial Sequence
  Description of Artificial Sequence: Synthetic polypeptide
EVQLLESGGGLVQPGGSLRLSCAASRFTFSTYAMSWVRQAPGKGLEWVSGISGSGVSTHYADSVKGRFTISRDNSKNTLYLQMNSLRAEDTAVYYCAKSLIVVIVYALDHWGQGTLVTVSS

SEQ ID NO: 71 - protein, 121 aa, Artificial Sequence
  Description of Artificial Sequence: Synthetic polypeptide
EVQLLESGGGLVQPGGYLRLSCAASGFTFSTYAMSWVRQAPGKGLEWVSAISGSGVSTYYADSVKGRFTISRDNSKNTLYLQMNSLRAEDTAVYYCAKSLIVVMVYVLDYWGQGTLVTVSS

SEQ ID NO: 72 - protein, 121 aa, Artificial Sequence
  Description of Artificial Sequence: Synthetic polypeptide
EVQLLESGGGLVQPGGYLRLSCAASGFTFSTYAMSWVRQAPGKGLEWVSAISGSGVSTNYADSVKGRFTISRDNSKNTLYLQMNSLRAEDTAVYYCAKSLIVVMVYVLDYWGQGTLVTVSS

SEQ ID NO: 73 - protein, 121 aa, Artificial Sequence
  Description of Artificial Sequence: Synthetic polypeptide
EVQLLESGGGLVQPGGSLRLSCAASRFTFSTYAMSWVRQAPGKGLEWVSGISGSGVSTYYADSVKGRFTISRDNSKNTLYLQMNSLRAEDTAVYYCAKSLIVVIVYALDYWGQGTLVTVSS

SEQ ID NO: 74 - protein, 121 aa, Artificial Sequence
  Description of Artificial Sequence: Synthetic polypeptide
QVQLQESGPGLVKPSETLSLTCTVSGGSISSYYWSWIRQPAGKGLEWIGRIYTSGSTNYNPSLKSRVTMSKDTSKNQFSLKLRSVTAADTAVYYCARDPDGDYYYYGMDVWGQGTSVTVSS

SEQ ID NO: 75 - protein, 121 aa, Artificial Sequence
  Description of Artificial Sequence: Synthetic polypeptide
QVQLQESGPGLVKPSETLSLTCTVSGGSISSYFWSWIRQPAGKGLEWIGRIYTSGSTNYNPSLKSRVTMSIDTSKNQFSLKLSSVTAADTAVYYCARDPDGDYYYYGMDVWGQGTTVTVSS

SEQ ID NO: 76 - protein, 127 aa, Artificial Sequence
  Description of Artificial Sequence: Synthetic polypeptide
EVQLVESGGGLVKPGGSLRLSCAASGFTFSDAWMSWVRQAPGKGLEWVGRIKSKTDGGTTDYAAPVKGRFTISRDDSKNTLYLQMNSLKTEDTAVYFCTSTYSSGWYVWDYYGMDVWGQGTTVTVSS

SEQ ID NO: 77 - protein, 127 aa, Artificial Sequence; identical to SEQ ID NO: 76
  Description of Artificial Sequence: Synthetic polypeptide

SEQ ID NO: 78 - protein, 128 aa, Artificial Sequence
  Description of Artificial Sequence: Synthetic polypeptide
QVQLVQSGAEVKKPGASVKVSCKVSGYTLTDLSMHWVRQAPGKGLEWMGGFDPEDGETIYAQKFQGRITMTEDTSTDTAYMELSSLRSEDTAVYYCASIVVVPAAIQSYYYYYGMGVWGQGTTVTVSS

SEQ ID NO: 79 - protein, 125 aa, Artificial Sequence
  Description of Artificial Sequence: Synthetic polypeptide
QVTLKEAGPVLVKPTETLTLTCTVSGFSLSNARMGVNWIRQPPGKALEWLAHIFSNDEKSYSTSLKSRLTISKDTSKSQVVLTMTNMDPVDTATYYCARVRIAGDYYYYYGMDVWGQGTTVTVSS

SEQ ID NO: 80 - protein, 127 aa, Artificial Sequence
  Description of Artificial Sequence: Synthetic polypeptide
QVQLQESGPGLVKPSQTLSLTCTVSGGSISSGGYNWSWIRQHPGKGLEWIGNIYYSGSTYYNPSLKSRVTISVDTSKNQFSLKLRSVTAADTAVYYCARENIVVIPAAIFAGWFDPWGQGTLVTVSS

SEQ ID NO: 81 - protein, 122 aa, Artificial Sequence
  Description of Artificial Sequence: Synthetic polypeptide
EVHLVESGGGLAKPGGSLRLSCAASGFTFRNAWMSWVRQAPGKGLEWVGRIKSKTDGGTTDYAAPVKGRFTISRDDSKNTLYLQMNSLKTEDTAEYYCITDRVLSYYAMAVWGQGTTVTVSS

SEQ ID NO: 82 - protein, 124 aa, Artificial Sequence
  Description of Artificial Sequence: Synthetic polypeptide
QVQLVESGGGVVQPGRSLRLSCAASGFTFSNYGIHWVRQAPGKGLEWVAVIWYDGSIKYYADSVKGRFTISRDNSKNTLYLQMNSLRAEDTAVYYCARDRAAAGLHYYYGMDVWGQGTTVTVSS

SEQ ID NO: 83 - protein, 124 aa, Artificial Sequence
  Description of Artificial Sequence: Synthetic polypeptide
QVQLVESGGGVVQPGRSLRLSCAASGFTFSSYGIHWVRQAPGKGLEWVAVIWYDGSDKYYADSVKGRFTISRDNSKNTLYLQMNSLRAEDTAVYYCARDRAAAGLHYYYGMDVWGQGTTVTVSS

SEQ ID NO: 84 - protein, 124 aa, Artificial Sequence
  Description of Artificial Sequence: Synthetic polypeptide
QVQLVESGGGVVQPGRSLRLSCAVSGFTFSSYGIHWVRQAPGKGLEWVAVIWYDGSDKYYGDSVKGRFTISRDNSKNTLYLQMNSLRAEDTAVYYCARDRAAAGLHYYYGMDVWGQGTTVTVSS

SEQ ID NO: 85 - DNA, 324 bp, Artificial Sequence
  Description of Artificial Sequence: Synthetic polynucleotide
tcctatgtgctgactcagccaccctcggtgtcagtggccccaggtcagacggccaggattacctgtgggggaaacaacattggaagtcagagtgtgcactggtaccagcagaagccaggccaggcccctgtcctggtcgtctatgatgatagcgaccggccctcagggatccctgagcgattctctggctccaactctgggaacacggccaccctgaccatcagcagggtcgaagccggggatgaggccgactattactgtcaggtgtgggatagtagtagtgatcatgtggtattcggcggagggaccaagctgaccgtccta

SEQ ID NO: 86 - DNA, 324 bp, Artificial Sequence
  Description of Artificial Sequence: Synthetic polynucleotide
tcctatgtgctgactcagccaccctcggtgtcagtggccccaggacagacggccaggattacctgtgggggaaacaacattggaagtcaaagtgtgcactggtaccagcagaagccaggccaggcccctgtcctggtcgtctatgatgatagcgaccggccctcagggatccctgagcgattctctggctccaactctgggaacacggccaccctgaccatcagcagggtcgaagccggggatgaggccgactattactgtcaggtgtgggataatactagtgatcatgtggtattcggcggggggaccaaactgaccgtccta

SEQ ID NO: 87 - DNA, 324 bp, Artificial Sequence
  Description of Artificial Sequence: Synthetic polynucleotide
tcctatgtgctgactcagccaccctcggtgtcagtggccccaggacagacggccaggattacctgtgggggaaacaacattggaagtgaaagtgtgcactggtaccagcagaagccaggccaggcccctgtgctggtcgtctatgatgatagcgaccggccctcagggatccctgagcgattctctggctccaactctgggaacacggccaccctgaccatcagcagggtcgaagccggggatgaggccgactattactgtcaggtgtgggatggtaatagtgatcatgtggtattcggcggagggaccaagctgaccgtccta

SEQ ID NO: 88 - DNA, 324 bp, Artificial Sequence
  Description of Artificial Sequence: Synthetic polynucleotide
gaaattgtgttgacgcagtctccaggcaccctgtctttgtctccaggggaaagagccaccctctcctgcagggccagtcagaattttgacagcagttacttagcctggtaccagcagaaacctggccaggctccccggctcctcatctatggtacatccagcagggccactggcatcccagacaggttcagtggcattgggtctgggacagacttcactctcaccatcaacagactggagcctgaagattttgcaatgtattactgtcagcagtatggtggctcaccgctcactttcggcggagggaccgaggtggaaatcaaa

SEQ ID NO: 89 - DNA, 324 bp, Artificial Sequence
  Description of Artificial Sequence: Synthetic polynucleotide
gaaattgtgttgacgcagtctccaggcaccctgtctttgtctccaggggaaagagccaccctctcctgcagggccagtcagagtgttagcggcaactacttggcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattattgtcagcagtatggtagcgcaccgctcactttcggcggagggaccaaggtggaaatcaaa

SEQ ID NO: 90 - DNA, 324 bp, Artificial Sequence
  Description of Artificial Sequence: Synthetic polynucleotide
gaaattgtgttgacgcagtctccaggcaccctgtctttgtctccaggggaaagagccaccctctcctgcagggccagtcagagtgttagcggcaactacttggcctggtaccagcagaaacctggccaggctcccaggctcctcatctatggtgcatccagcagggccactggcatcccagacagattcagtggcagtgggtctgggacagacttcactctcaccatcagcagactggagcctgaagattttgcaatgtattattgtcagcagtatggtagctcaccgctcactttcggcggagggtccaaggtggagatcaaa

SEQ ID NO: 91 - DNA, 324 bp, Artificial Sequence
  Description of Artificial Sequence: Synthetic polynucleotide
gaaattgtgttgacgcagtctccaggcaccctgtctttgtctccaggggaaagagccaccctctcctgcagggccagtcagaatttcgacagcaactacttagcctggtaccagcagaagcctggccaggctccccggctcctcatctatggtgcatccagcagggccactggcatcccagacaacttcagtggcagtgggtctgggacagacttcactctcaccatcagcagactggagcctgaagattttgcaatgtattactgtcagcagtatggtagttcaccgctcactttcggcggagggaccaaggtggaaatcaaa

SEQ ID NO: 92 - DNA, 324 bp, Artificial Sequence
  Description of Artificial Sequence: Synthetic polynucleotide
gaaattgtgttgacgcagtctccaggcaccctgtctttgtctccaggggaaagggccaccctctcctgcagggccagtcagaattttgacagcagctccttagcctggtaccagcagaaacctggccaggctccccggctcctcatctatggtgcatccagcagggccactggcatcccagacaggttcagtggcagtgggtctgggacagacttcactctcaccatcagcagactggagcctgaagattttgcaatgtattactgtcagcagtgtggtagctcaccgctcactttcggcggagggaccaaggtggaaatcaaa

SEQ ID NO: 93 - DNA, 321 bp, Artificial Sequence
  Description of Artificial Sequence: Synthetic polynucleotide
gaaattgtgttgacgcagtctccaggcaccctgtctttgtctccaggggaaagagccaccctctcctgcagggccagtcagagtgttagcagtacctacttagcctggcaccagcagaaacctggccagggtcttaggctcctcatctatggtgcatccagcagggccactggcatcccagacaggttcagtggcagtgggtctgggacagacttcactcttaccatcagcagactggagcctgaagattttgcagtgtattactgtcagcagtatggaagctcattcactttcggcggagggaccagggtggagatcaaa

SEQ ID NO: 94 - DNA, 336 bp, Artificial Sequence
  Description of Artificial Sequence: Synthetic polynucleotide
gatattgtgatgactcagtctccactctccctgcccgtcacccctggagagccggcctccatctcctgcaggtctagtcagagcctcctgtattataatggattcacctatttggattggttcctgcagaagccagggcagtctccacatctcctgatctatttgggttctaatcgggcctccggggtccctgacaggttcagtggcagtgtttcaggcacagattttacactgaaaatcagcagagtggaggctgaggatgttggggtttattattgcatgcagtctctgcaaactccattcactttcggccctgggaccaaagtggatatcaaa

SEQ ID NO: 95 - DNA, 321 bp, Artificial Sequence
  Description of Artificial Sequence: Synthetic polynucleotide
gaaatagtgatgacgcagtctccagccaccctgtctgtgtctccaggggaaagagccaccctctcctgcagggccagtcagagtgttaacagcaacttagcctggtaccagcagaaacctggccaggctcccaggctcctcatttatggtgtatccaccagggccactggtatcccagccaggttcagtggcagtgggtctgggacagagttcactctcaccatccgcagcctgcagtctgaagattttgcagtttattactgtcagcagtataataactggcctccgacgttcggccaagggaccaaggtggaaatcaaa

SEQ ID NO: 96 - DNA, 321 bp, Artificial Sequence
  Description of Artificial Sequence: Synthetic polynucleotide
gacatacagctgacccagtctccatcctccctgtctgcatctataggagacagagtcaccatcacttgccgggcaagtcaggacattagatatgatttaggctggtatcagcagaaaccagggaaagcccctaagcgcctgatctatgctgcatccagtttgcaaagtggggtcccttcaaggttcagcggcagtggatctgggacagaattcactctcacagtcagcagcctgcagcctgaagattttgcaacttattactgtctacagcataatagttaccctctcactttcggcggagggaccaaggtggagatcgaa

SEQ ID NO: 97 - DNA, 321 bp, Artificial Sequence
  Description of Artificial Sequence: Synthetic polynucleotide
gacatccagatgacccagtctccctcttccgtgtctgcatctgtaggagacagagtcaccatcacttgtcgggcgagtcagggtattagcatctggttagcctggtatcagcagaaacctgggaaagcccctaaactcctgatctatgctgcatccagtttgcaaagtggggtcccatcaaggttcagcggcagtggatctgggacagatttcactctcaccatcagcagcctgcagcctgaagattttgcaacttactattgtcaacaggctaacgatttcccgatcaccttcggccaagggacacgactggagattaaa

SEQ ID NO: 98 - DNA, 336 bp, Artificial Sequence
  Description of Artificial Sequence: Synthetic polynucleotide
gattttgtgatgacccagactccactctctctgtccgtcacccctggacagccggcctccatctcctgcaagtctagtcagagcctcctacagagtgatggaaagacctatttgtattggtacctgcagaagccaggccagcctccacatctcctgatctatgaagtttccaaccgattctctggagtgccagataggttcagtggcagcgggtcagggacagatttcacactgaaaatcagccgggtggaggctgaggatgttggggtttattactgcatgcaaagtatacagcttcctcggacgttcggccaagggaccaaggtggaaatcaaa

SEQ ID NO: 99 - DNA, 336 bp, Artificial Sequence
  Description of Artificial Sequence: Synthetic polynucleotide
gatattgtgatgactcagtctccactctccctgcccgtcacccctggagagccggcctccatctcctgcaggtctagtcagagcctcctgcatagtaatggatacaactttttggattggtacctacagaagccagggcagtctccacagctcctgatctatttgggttctgatcgggcctccggggtccctgacaggttcagtggcagtggatcaggcacagagtttacactgaaaatcagcagagtggaggctgaggatgttgggctttattactgcatgcaagctctacaaactccgtgcagttttggccaggggaccaagctggagatcaaa

SEQ ID NO: 100 - DNA, 324 bp, Artificial Sequence
  Description of Artificial Sequence: Synthetic polynucleotide
gaaattgtgttgacgcagtctccaggcaccctgtctttgtctccaggggaaagagccaccctctcctgcagggccagtcagagtgttagtagcacctatttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtttattactgtcagcagtctggtagctcaccgctcactttcggcggagggaccgaggtggagatcaaa

SEQ ID NO: 101 - DNA, 324 bp, Artificial Sequence
  Description of Artificial Sequence: Synthetic polynucleotide
gaaattgtgttgacgcagtctccaggcaccctgtctttgtctccaggggaaagagccaccctctcctgcagggccagtcagagtgttagcagcacctacttagcctggtaccagcagaaacctggccaggctcccagtctcctcatctatggtgcatccagcagggccactggcatcccagacaggttcagtggcagtgggtctgggacagacttcactctcaccatcagcagactggagcctgaggattttgcagtgtattactgtcagcagtctggtagctcacctctcactttcggcggagggaccaaggtggagatcaaa

SEQ ID NO: 102 - DNA, 324 bp, Artificial Sequence
  Description of Artificial Sequence: Synthetic polynucleotide
gaaattgtgttgacgcagtctccaggcaccctgtctttgtctccaggggaaagagccaccctctcctgcagggccagtcagagtgttagcagcacctacttagcctggtaccagcagaaacctggccaggctcccaggctcctcatctatggtgcatccttcagggccactggcatcccagacaggttcagtggcagtgggtctgggacagacttcactctcaccatcagcagactggagcctgaggattttgcagtgtattactgtcagcagtctggtagctcacctctcactttcggcggagggaccaaggtggagatcaaa

SEQ ID NO: 103 - DNA, 372 bp, Artificial Sequence
  Description of Artificial Sequence: Synthetic polynucleotide
caggtcaccttgaaggagtctggtcctgtgctggtgaaacccacagagaccctcacgctgacctgcaccgtctctgggttctcactcagcaatgctagaatgggtgtgagctggatccgtcagcccccagggaaggccctggagtggcttgcacacattttttcgaatgacgaaaaatcctacagcacatctctgaagagcaggctcaccatctccaaggacacctccaaaagccaggtggtccttaccatgaccaacatggaccctgtggacacagccacatattactgtgcacggatattattactgggagcttactactactacggtatggacgtctggggccaagggaccacggtcaccgtctcctca

SEQ ID NO: 104 - DNA, 372 bp, Artificial Sequence
  Description of Artificial Sequence: Synthetic polynucleotide
caggtcaccttgaaggagtctggtcctgtgctggtgaaacccacagagaccctcacgctgacctgcaccgtctctgggttctcactcagcaatgctagaatgggtgtgagctggatccgtcagcccccagggaaggccctggagtggcttgcacacattttttcgaatgacgaaaaatcctacagcacatctctgaagagcaggctcaccatctccaaggacacctccaaaagccaggtggtccttaccatgaccaacatggaccctgtggacacagccacatattactgtgcacggatattattagtgggagcttactactactgcggtatggacgtctggggccaagggaccacggtcaccgtctcctca

SEQ ID NO: 105 - DNA, 372 bp, Artificial Sequence
  Description of Artificial Sequence: Synthetic polynucleotide
caggtcaccttgaaggagtctggtcctgtgctggtgaaacccacagagaccctcacgctgacctgcaccgtctctgggttctcactcaacaatgctagaatgggtgtgagctggatccgtcagcccccagggaaggccctggagtggcttgcacacattttttcgaatgacgaaaaatcctacagcacatctctgaagagcaggctcaccatctccaaggacacctccaaaagccaggtggtcctaattatgaccaacatggaccctgtggacacagccacatattactgtgcacggtcagtagtaactggcggctactactacgacggtatggacgtctggggccaagggaccacggtcaccgtctcctca

SEQ ID NO: 106 - DNA, 372 bp, Artificial Sequence
  Description of Artificial Sequence: Synthetic polynucleotide
caggtcaccttgaaggagtctggtcctgtgctggtgaaacccacagagaccctcacgctgacctgcaccgtctctgggttctcactcagcaatgctagaatgggtgtgagctggatccgtcagcccccagggaaggccctggagtggcttgcacacattttttcgaatgacgaaaaatcctacagcacatctctgaagaacaggctcaccatctccaaggacacctccaaaagccaggtggtccttattatgaccaacatggaccctgtggacacagccacatattactgtgcacggtcagtagtgactggcggctactactacgacggtatggacgtctggggccaagggaccacggtcaccgtctcctca

SEQ ID NO: 107 - DNA, 363 bp, Artificial Sequence
  Description of Artificial Sequence: Synthetic polynucleotide
gaggtgcagctgttggagtctgggggagggttggtacagccgggggggtccctgagactctcctgtgcagcctctagattcacctttagcacctatgccatgagctgggtccgccaggctccagggaaggggctggagtgggtctcaggtattagtggtagtggtgtcagcacacactacgcagactccgtgaagggccggttcaccatctccagagacaattccaagaacacgctgtatctgcaaatgaacagcctgagagccgaggacacggccgtatattactgtgcgaaatccctcattgtagtaatagtatatgcccttgaccactggggccagggaaccctggtcaccgtctcctca

SEQ ID NO: 108 - DNA, 363 bp, Artificial Sequence
  Description of Artificial Sequence: Synthetic polynucleotide
gaggtgcagctgttggagtctgggggaggcttggtacagccgggggggtacctgagactctcctgtgcagcctctggattcacgtttagtacctatgccatgagctgggtccgccaggctccagggaagggactggagtgggtctcagctatcagtggtagtggtgttagcacatactacgcagactccgtgaagggccggttcaccatctccagagacaattccaagaacacgctgtatctgcaaatgaacagcctgagagccgaggacacggccgtatattactgtgcgaaatcccttattgtagtaatggtgtatgtccttgactactggggccagggaaccctggtcaccgtctcctca

SEQ ID NO: 109 - DNA, 363 bp, Artificial Sequence
  Description of Artificial Sequence: Synthetic polynucleotide
gaggtgcagctgttggagtctgggggaggcttggtacagccgggggggtacctgagactctcctgtgcagcctctggattcacgtttagcacctatgccatgagctgggtccgccaggctccagggaagggactggagtgggtctcagctattagtggcagtggtgtgagcacaaactacgcagactccgtgaagggccggttcaccatctccagagacaattccaagaacacgctgtatctgcaaatgaacagcctgagagccgaggacacggccgtatattactgtgcgaaatcccttattgtagtaatggtgtatgtccttgactactggggccagggaaccctggtcaccgtctcctca

SEQ ID NO: 110 - DNA, 363 bp, Artificial Sequence
  Description of Artificial Sequence: Synthetic polynucleotide
gaggtgcagctgttggagtctgggggagggttggtacagccgggggggtccctgagactctcctgtgcagcctctagattcacctttagcacctatgccatgagctgggtccgccaggctccagggaaggggctggagtgggtctcaggtattagtggtagtggtgttagcacatactacgcagactccgtgaagggccggttcaccatctccagagacaattccaagaacacgctgtatctgcaaatgaacagcctgagagccgaggacacggccgtatattactgtgcgaaatcccttattgtagtaatagtatatgcccttgactactggggccagggaaccctggtcaccgtctcctca

SEQ ID NO: 111 - DNA, 363 bp, Artificial Sequence
  Description of Artificial Sequence: Synthetic polynucleotide
caggtgcagctgcaggagtcgggcccaggactggtgaagccttcggagaccctgtccctcacctgcactgtctctggtggctccatcagtagttactactggagctggatccggcagcccgccgggaagggactggagtggattgggcgtatctataccagtgggagcaccaactacaacccctccctcaagagtcgggtcaccatgtcaaaagacacgtccaagaaccagttctccctgaagctgaggtctgtgaccgccgcggacacggccgtgtattactgtgcgagagatccggacggtgactactactactacggtatggacgtctggggccaagggacctcggtcaccgtctcctca

SEQ ID NO: 112 - DNA, 363 bp, Artificial Sequence
  Description of Artificial Sequence: Synthetic polynucleotide
caggtgcagctgcaggagtcgggcccaggactggtgaagccttcggagaccctgtccctcacctgcactgtctctggtggctccatcagtagttacttctggagctggatccggcagcccgccgggaagggactggagtggattgggcgtatctataccagtgggagcaccaactacaacccctccctcaagagtcgagtcaccatgtcaatagacacgtccaagaaccagttctccctgaagctgagttctgtgaccgccgcggacacggccgtgtattactgtgcgagagatccggacggtgactactactactacggtatggacgtctggggccaagggaccacggtcaccgtctcctca

SEQ ID NO: 113 - DNA, 381 bp, Artificial Sequence
  Description of Artificial Sequence: Synthetic polynucleotide
gaggtgcagctggtggagtctgggggaggcttggtaaagcctggggggtcccttagactctcctgtgcagcctctggattcactttcagtgacgcctggatgagctgggtccgccaggctccagggaaggggctggagtgggttggccgtattaaaagcaaaactgatggtgggacaacagactacgctgcacccgtgaaaggcagattcaccatctcaagagatgattcaaaaaacactctgtatctgcaaatgaacagcctgaaaaccgaggacacagccgtgtatttttgtacctctacgtatagcagtggctggtacgtatgggactactacggtatggacgtctggggccaagggaccacggtcaccgtctcctca

SEQ ID NO: 114 - DNA, 384 bp, Artificial Sequence
  Description of Artificial Sequence: Synthetic polynucleotide
caggtccagctggtacagtctggggctgaggtgaagaagcctggggcctcagtgaaggtctcctgcaaggtttcgggatacaccctcactgatttatccatgcactgggtgcgacaggctcctggaaaagggcttgagtggatgggaggttttgatcctgaagatggtgaaacaatctacgcacagaagttccagggcagaatcaccatgaccgaggacacatctacagacacagcctacatggagctgagcagcctgagatctgaggacacggccgtgtattactgtgcaagtattgtagtagtcccagctgctatacagagttactactactactacggtatgggcgtctggggccaagggaccacggtcaccgtctcctcc

SEQ ID NO: 115 - DNA, 375 bp, Artificial Sequence
  Description of Artificial Sequence: Synthetic polynucleotide
caggtcaccttgaaggaggctggtcctgtgttggtgaaacccacagagaccctcacgttgacctgcaccgtctctgggttctcactcagcaatgctagaatgggtgtgaactggatccgtcagcccccagggaaggccctggagtggcttgcacacattttttcgaatgacgaaaaatcctacagcacatctctgaagagcaggctcaccatctccaaggacacctccaaaagccaggtggtccttaccatgaccaacatggaccctgtggacacagccacatattactgtgcacgggttcgtatagcaggtgattactactactactacggtatggacgtctggggccaagggaccacggtcaccgtctcctca

SEQ ID NO: 116 - DNA, 381 bp, Artificial Sequence
  Description of Artificial Sequence: Synthetic polynucleotide
caggtgcagctgcaggagtcgggcccaggactggtgaagccttcacagaccctgtccctcacctgcactgtctctggtggctccatcagcagtggtggttacaactggagctggatccgccagcacccagggaagggcctggagtggattgggaacatctattacagtgggagcacctactacaacccgtccctcaagagtcgagttaccatatcagtagacacgtctaagaaccagttctccctgaagctgagatctgtgactgccgcggacacggccgtgtattactgtgcgagagagaatattgtagtaataccagctgctatattcgcgggttggttcgacccctggggccagggaaccctggtcaccgtctcctca

SEQ ID NO: 117 - DNA, 366 bp, Artificial Sequence
  Description of Artificial Sequence: Synthetic polynucleotide
gaggtgcacctggtggagtctgggggaggcttggcaaagcctggggggtcccttagactctcctgtgcagcctctggattcactttcagaaacgcctggatgagctgggtccgccaggctccaggaaaggggctggaatgggttggccgtattaaaagcaaaactgatggtgggacaacagactacgctgcacccgtgaaaggcagattcaccatctcgagagatgattcaaaaaacacgctgtatctgcaaatgaacagcctgaaaaccgaggacacagccgagtattactgtatcacagatcgggtgctaagctactacgctatggccgtctggggccaagggaccacggtcaccgtctcctca

SEQ ID NO: 118 - DNA, 372 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtaactatggcattcactgggtccgccaggctccaggcaaggggctggagtgggtggcagttatatggtatgatggaagtattaaatactatgcagactccgtgaagggccgattcaccatctccagagacaattccaagaacacgctgtatctgcaaatgaacagcctgagagccgaggacacggctgtgtattactgtgcgagagatagggcagcagctggtctccactactactacggtatggacgtctggggccaagggaccacggtcaccgtctcctca

SEQ ID NO: 119 - DNA, 372 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccttcagtagctatggcatccactgggtccgccaggctccaggcaaggggctggaatgggtggcagttatatggtatgatggaagtgataaatactatgcagactccgtgaagggccgattcaccatctccagagacaattccaagaacacgctgtatctacaaatgaacagcctgagagccgaggacacggctgtgtattactgtgcgagagatagggcagcagctggtctccactattattacggtatggacgtctggggccaagggaccacggtcaccgtctcctca

SEQ ID NO: 120 - DNA, 372 bp, Artificial Sequence
  Description of Artificial Sequence: Synthetic polynucleotide
caggtgcagctggtggagtctgggggaggcgtggtccagcctgggaggtccctgagactctcctgtgcagtgtctggattcaccttcagtagctatggcatccactgggtccgccaggctccaggcaaggggctggaatgggtggcagttatatggtatgatggaagtgataaatactatggagactccgtgaagggccgattcaccatctccagagacaattccaagaacacgctgtatctacaaatgaacagcctgagagccgaggacacggctgtgtattactgtgcgagagatagggcagcagctggtctccactattattacggtatggacgtctggggccaagggaccacggtcaccgtctcctca

SEQ ID NO: 121 - protein, 5 aa, Artificial Sequence
  Description of Artificial Sequence: Synthetic peptide
DLSMH

SEQ ID NO: 122 - protein, 7 aa, Artificial Sequence
  Description of Artificial Sequence: Synthetic peptide
NARMGVS

SEQ ID NO: 123 - protein, 5 aa, Artificial Sequence
  Description of Artificial Sequence: Synthetic peptide
DAWMS

SEQ ID NO: 124 - protein, 5 aa, Artificial Sequence
  Description of Artificial Sequence: Synthetic peptide
TYAMS

SEQ ID NO: 125 - protein, 5 aa, Artificial Sequence
  Description of Artificial Sequence: Synthetic peptide
SYFWS

SEQ ID NO: 126 - protein, 7 aa, Artificial Sequence
  Description of Artificial Sequence: Synthetic peptide
NARMGVN

SEQ ID NO: 127 - protein, 5 aa, Artificial Sequence
  Description of Artificial Sequence: Synthetic peptide
NAWMS

SEQ ID NO: 128 - protein, 5 aa, Artificial Sequence
  Description of Artificial Sequence: Synthetic peptide
SYGIH

SEQ ID NO: 129 - protein, 5 aa, Artificial Sequence
  Description of Artificial Sequence: Synthetic peptide
NYGIH

SEQ ID NO: 130 - protein, 7 aa, Artificial Sequence
  Description of Artificial Sequence: Synthetic peptide
SGGYNWS

SEQ ID NO: 131 - protein, 5 aa, Artificial Sequence
  Description of Artificial Sequence: Synthetic peptide
SYYWS

SEQ ID NO: 132 - protein, 17 aa, Artificial Sequence
  Description of Artificial Sequence: Synthetic peptide
GFDPEDGETIYAQKFQG

SEQ ID NO: 133 - protein, 16 aa, Artificial Sequence
  Description of Artificial Sequence: Synthetic peptide
HIFSNDEKSYSTSLKS

SEQ ID NO: 134 - protein, 16 aa, Artificial Sequence
  Description of Artificial Sequence: Synthetic peptide
HIFSNDEKSYSTSLKN

SEQ ID NO: 135 - protein, 19 aa, Artificial Sequence
  Description of Artificial Sequence: Synthetic peptide
RIKSKTDGGTTDYAAPVKG

SEQ ID NO: 136 - protein, 17 aa, Artificial Sequence
  Description of Artificial Sequence: Synthetic peptide
GISGSGVSTHYADSVKG

SEQ ID NO: 137 - protein, 17 aa, Artificial Sequence
  Description of Artificial Sequence: Synthetic peptide
GISGSGVSTYYADSVKG

SEQ ID NO: 138 - protein, 17 aa, Artificial Sequence
  Description of Artificial Sequence: Synthetic peptide
AISGSGVSTYYADSVKG

SEQ ID NO: 139 - protein, 17 aa, Artificial Sequence
  Description of Artificial Sequence: Synthetic peptide
AISGSGVSTNYADSVKG

SEQ ID NO: 140 - protein, 16 aa, Artificial Sequence
  Description of Artificial Sequence: Synthetic peptide
RIYTSGSTNYNPSLKS

SEQ ID NO: 141 - protein, 17 aa, Artificial Sequence
  Description of Artificial Sequence: Synthetic peptide
VIWYDGSDKYYADSVKG

SEQ ID NO: 142 - protein, 17 aa, Artificial Sequence
  Description of Artificial Sequence: Synthetic peptide
VIWYDGSIKYYADSVKG

SEQ ID NO: 143 - protein, 17 aa, Artificial Sequence
  Description of Artificial Sequence: Synthetic peptide
VIWYDGSDKYYGDSVKG

SEQ ID NO: 144 - protein, 16 aa, Artificial Sequence
  Description of Artificial Sequence: Synthetic peptide
NIYYSGSTYYNPSLKS

SEQ ID NO: 145 - protein, 19 aa, Artificial Sequence
  Description of Artificial Sequence: Synthetic peptide
IVVVPAAIQSYYYYYGMGV

SEQ ID NO: 146 - protein, 14 aa, Artificial Sequence
  Description of Artificial Sequence: Synthetic peptide
ILLLGAYYYYGMDV

SEQ ID NO: 147 - protein, 14 aa, Artificial Sequence
  Description of Artificial Sequence: Synthetic peptide
ILLVGAYYYCGMDV

SEQ ID NO: 148 - protein, 14 aa, Artificial Sequence
  Description of Artificial Sequence: Synthetic peptide
SVVTGGYYYDGMDV

SEQ ID NO: 149 - protein, 16 aa, Artificial Sequence
  Description of Artificial Sequence: Synthetic peptide
TYSSGWYVWDYYGMDV

SEQ ID NO: 150 - protein, 12 aa, Artificial Sequence
  Description of Artificial Sequence: Synthetic peptide
SLIVVIVYALDH

SEQ ID NO: 151 - protein, 12 aa, Artificial Sequence
  Description of Artificial Sequence: Synthetic peptide
SLIVVIVYALDY

SEQ ID NO: 152 - protein, 12 aa, Artificial Sequence
  Description of Artificial Sequence: Synthetic peptide
SLIVVMVYVLDY

SEQ ID NO: 153 - protein, 13 aa, Artificial Sequence
  Description of Artificial Sequence: Synthetic peptide
DPDGDYYYYGMDV

SEQ ID NO: 154 - protein, 15 aa, Artificial Sequence
  Description of Artificial Sequence: Synthetic peptide
VRIAGDYYYYYGMDV

SEQ ID NO: 155 - protein, 11 aa, Artificial Sequence
  Description of Artificial Sequence: Synthetic peptide
DRVLSYYAMAV

SEQ ID NO: 156 - protein, 15 aa, Artificial Sequence
  Description of Artificial Sequence: Synthetic peptide
DRAAAGLHYYYGMDV

SEQ ID NO: 157 - protein, 17 aa, Artificial Sequence
  Description of Artificial Sequence: Synthetic peptide
ENIVVIPAAIFAGWFDP

SEQ ID NO: 158 - protein, 11 aa, Artificial Sequence
  Description of Artificial Sequence: Synthetic peptide
RASQDIRYDLG

SEQ ID NO: 159 - protein, 16 aa, Artificial Sequence
  Description of Artificial Sequence: Synthetic peptide
RSSQSLLYYNGFTYLD

SEQ ID NO: 160 - protein, 12 aa, Artificial Sequence
  Description of Artificial Sequence: Synthetic peptide
RASQNFDSSSLA

SEQ ID NO: 161 - protein, 12 aa, Artificial Sequence
  Description of Artificial Sequence: Synthetic peptide
RASQNFDSSYLA

SEQ ID NO: 162 - protein, 12 aa, Artificial Sequence
  Description of Artificial Sequence: Synthetic peptide
RASQSVSGNYLA

SEQ ID NO: 163 - protein, 12 aa, Artificial Sequence
  Description of Artificial Sequence: Synthetic peptide
RASQSVSSTYLA

SEQ ID NO: 164 - protein, 12 aa, Artificial Sequence
  Description of Artificial Sequence: Synthetic peptide
RASQNFDSNYLA

SEQ ID NO: 165 - protein, 11 aa, Artificial Sequence
  Description of Artificial Sequence: Synthetic peptide
RASQSVNSNLA

SEQ ID NO: 166 - protein, 11 aa, Artificial Sequence
  Description of Artificial Sequence: Synthetic peptide
GGNNIGSESVH

SEQ ID NO: 167 - protein, 11 aa, Artificial Sequence
  Description of Artificial Sequence: Synthetic peptide
GGNNIGSQSVH

SEQ ID NO: 168 - protein, 11 aa, Artificial Sequence
  Description of Artificial Sequence: Synthetic peptide
RASQGISIWLA

SEQ ID NO: 169 - protein, 16 aa, Artificial Sequence
  Description of Artificial Sequence: Synthetic peptide
KSSQSLLQSDGKTYLY

SEQ ID NO: 170 - protein, 16 aa, Artificial Sequence
  Description of Artificial Sequence: Synthetic peptide
RSSQSLLHSNGYNFLD

SEQ ID NO: 171 - protein, 7 aa, Artificial Sequence
  Description of Artificial Sequence: Synthetic peptide
AASSLQS

SEQ ID NO: 172 - protein, 7 aa, Artificial Sequence
  Description of Artificial Sequence: Synthetic peptide
LGSNRAS

SEQ ID NO: 173 - protein, 7 aa, Artificial Sequence
  Description of Artificial Sequence: Synthetic peptide
GASSRAT

SEQ ID NO: 174 - protein, 7 aa, Artificial Sequence
  Description of Artificial Sequence: Synthetic peptide
GTSSRAT

SEQ ID NO: 175 - protein, 7 aa, Artificial Sequence
  Description of Artificial Sequence: Synthetic peptide
GVSTRAT

SEQ ID NO: 176 - protein, 7 aa, Artificial Sequence
  Description of Artificial Sequence: Synthetic peptide
DDSDRPS

SEQ ID NO: 177 - protein, 7 aa, Artificial Sequence
  Description of Artificial Sequence: Synthetic peptide
EVSNRFS

SEQ ID NO: 178 - protein, 7 aa, Artificial Sequence
  Description of Artificial Sequence: Synthetic peptide
LGSDRAS

SEQ ID NO: 179 - protein, 7 aa, Artificial Sequence
  Description of Artificial Sequence: Synthetic peptide
GASFRAT

SEQ ID NO: 180 - protein, 9 aa, Artificial Sequence
  Description of Artificial Sequence: Synthetic peptide
LQHNSYPLT

SEQ ID NO: 181 - protein, 9 aa, Artificial Sequence
  Description of Artificial Sequence: Synthetic peptide
MQSLQTPFT

SEQ ID NO: 182 - protein, 9 aa, Artificial Sequence
  Description of Artificial Sequence: Synthetic peptide
QQCGSSPLT

SEQ ID NO: 183 - protein, 9 aa, Artificial Sequence
  Description of Artificial Sequence: Synthetic peptide
QQYGGSPLT

SEQ ID NO: 184 - protein, 9 aa, Artificial Sequence
  Description of Artificial Sequence: Synthetic peptide
QQYGSAPLT

SEQ ID NO: 185 - protein, 8 aa, Artificial Sequence
  Description of Artificial Sequence: Synthetic peptide
QQYGSSFT

SEQ ID NO: 186 - protein, 9 aa, Artificial Sequence
  Description of Artificial Sequence: Synthetic peptide
QQYGSSPLT

SEQ ID NO: 187 - protein, 9 aa, Artificial Sequence
  Description of Artificial Sequence: Synthetic peptide
QQYNNWPPT

SEQ ID NO: 188 - protein, 11 aa, Artificial Sequence
  Description of Artificial Sequence: Synthetic peptide
QVWDGNSDHVV

SEQ ID NO: 189 - protein, 11 aa, Artificial Sequence
  Description of Artificial Sequence: Synthetic peptide
QVWDNTSDHVV

SEQ ID NO: 190 - protein, 11 aa, Artificial Sequence
  Description of Artificial Sequence: Synthetic peptide
QVWDSSSDHVV

SEQ ID NO: 191 - protein, 9 aa, Artificial Sequence
  Description of Artificial Sequence: Synthetic peptide
QQANDFPIT

SEQ ID NO: 192 - protein, 9 aa, Artificial Sequence
  Description of Artificial Sequence: Synthetic peptide
MQSIQLPRT

SEQ ID NO: 193 - protein, 9 aa, Artificial Sequence
  Description of Artificial Sequence: Synthetic peptide
MQALQTPCS

SEQ ID NO: 194 - protein, 9 aa, Artificial Sequence
  Description of Artificial Sequence: Synthetic peptide
QQSGSSPLT

SEQ ID NO: 195 - DNA, 15 bp, Artificial Sequence
  Description of Artificial Sequence: Synthetic oligonucleotide
gatttatccatgcac

SEQ ID NO: 196 - DNA, 21 bp, Artificial Sequence
  Description of Artificial Sequence: Synthetic oligonucleotide
aatgctagaatgggtgtgagc

SEQ ID NO: 197 - DNA, 15 bp, Artificial Sequence
  Description of Artificial Sequence: Synthetic oligonucleotide
gacgcctggatgagc

SEQ ID NO: 198 - DNA, 15 bp, Artificial Sequence
  Description of Artificial Sequence: Synthetic oligonucleotide
acctatgccatgagc

SEQ ID NO: 199 - DNA, 15 bp, Artificial Sequence
  Description of Artificial Sequence: Synthetic oligonucleotide
agttacttctggagc

SEQ ID NO: 200 - DNA, 21 bp, Artificial Sequence
  Description of Artificial Sequence: Synthetic oligonucleotide
aatgctagaatgggtgtgaac

SEQ ID NO: 201 - DNA, 15 bp, Artificial Sequence
  Description of Artificial Sequence: Synthetic oligonucleotide
aacgcctggatgagc

SEQ ID NO: 202 - DNA, 15 bp, Artificial Sequence
  Description of Artificial Sequence: Synthetic oligonucleotide
agctatggcatccac

SEQ ID NO: 203 - DNA, 15 bp, Artificial Sequence
  Description of Artificial Sequence: Synthetic oligonucleotide
aactatggcattcac

SEQ ID NO: 204 - DNA, 21 bp, Artificial Sequence
  Description of Artificial Sequence: Synthetic oligonucleotide
agtggtggttacaactggagc

SEQ ID NO: 205 - DNA, 51 bp, Artificial Sequence
  Description of Artificial Sequence: Synthetic oligonucleotide
ggttttgatcctgaagatggtgaaacaatctacgcacagaagttccagggc

SEQ ID NO: 206 - DNA, 48 bp, Artificial Sequence
  Description of Artificial Sequence: Synthetic oligonucleotide
cacattttttcgaatgacgaaaaatcctacagcacatctctgaagagc

SEQ ID NO: 207 - DNA, 48 bp, Artificial Sequence
  Description of Artificial Sequence: Synthetic oligonucleotide
cacattttttcgaatgacgaaaaatcctacagcacatctctgaagaac

SEQ ID NO: 208 - DNA, 57 bp, Artificial Sequence
  Description of Artificial Sequence: Synthetic oligonucleotide
cgtattaaaagcaaaactgatggtgggacaacagactacgctgcacccgtgaaaggc

SEQ ID NO: 209 - DNA, 51 bp, Artificial Sequence
  Description of Artificial Sequence: Synthetic oligonucleotide
ggtattagtggtagtggtgtcagcacacactacgcagactccgtgaagggc

SEQ ID NO: 210 - DNA, 51 bp, Artificial Sequence
  Description of Artificial Sequence: Synthetic oligonucleotide
ggtattagtggtagtggtgttagcacatactacgcagactccgtgaagggc

SEQ ID NO: 211 - DNA, 51 bp, Artificial Sequence
  Description of Artificial Sequence: Synthetic oligonucleotide
gctatcagtggtagtggtgttagcacatactacgcagactccgtgaagggc

SEQ ID NO: 212 - DNA, 51 bp, Artificial Sequence
  Description of Artificial Sequence: Synthetic oligonucleotide
gctattagtggcagtggtgtgagcacaaactacgcagactccgtgaagggc

SEQ ID NO: 213 - DNA, 48 bp, Artificial Sequence
  Description of Artificial Sequence: Synthetic oligonucleotide
cgtatctataccagtgggagcaccaactacaacccctccctcaagagt

SEQ ID NO: 214 - DNA, 51 bp, Artificial Sequence
  Description of Artificial Sequence: Synthetic oligonucleotide
gttatatggtatgatggaagtgataaatactatgcagactccgtgaagggc

SEQ ID NO: 215 - DNA, 51 bp, Artificial Sequence
  Description of Artificial Sequence: Synthetic oligonucleotide
gttatatggtatgatggaagtattaaatactatgcagactccgtgaagggc

SEQ ID NO: 216 - DNA, 51 bp, Artificial Sequence
  Description of Artificial Sequence: Synthetic oligonucleotide
gttatatggtatgatggaagtgataaatactatggagactccgtgaagggc

SEQ ID NO: 217 - DNA, 48 bp, Artificial Sequence
  Description of Artificial Sequence: Synthetic oligonucleotide
aacatctattacagtgggagcacctactacaacccgtccctcaagagt

SEQ ID NO: 218 - DNA, 57 bp, Artificial Sequence
  Description of Artificial Sequence: Synthetic oligonucleotide
attgtagtagtcccagctgctatacagagttactactactactacggtatgggcgtc

SEQ ID NO: 219 - DNA, 42 bp, Artificial Sequence
  Description of Artificial Sequence: Synthetic oligonucleotide
atattattactgggagcttactactactacggtatggacgtc

SEQ ID NO: 220 - DNA, 42 bp, Artificial Sequence
  Description of Artificial Sequence: Synthetic oligonucleotide
atattattagtgggagcttactactactgcggtatggacgtc

SEQ ID NO: 221 - DNA, 42 bp, Artificial Sequence
  Description of Artificial Sequence: Synthetic oligonucleotide
tcagtagtaactggcggctactactacgacggtatggacgtc

SEQ ID NO: 222 - DNA, 48 bp, Artificial Sequence
  Description of Artificial Sequence: Synthetic oligonucleotide
acgtatagcagtggctggtacgtatgggactactacggtatggacgtc

SEQ ID NO: 223 - DNA, 36 bp, Artificial Sequence
  Description of Artificial Sequence: Synthetic oligonucleotide
tccctcattgtagtaatagtatatgcccttgaccac

SEQ ID NO: 224 - DNA, 36 bp, Artificial Sequence
  Description of Artificial Sequence: Synthetic oligonucleotide
tcccttattgtagtaatagtatatgcccttgactac

SEQ ID NO: 225 - DNA, 36 bp, Artificial Sequence
  Description of Artificial Sequence: Synthetic oligonucleotide
tcccttattgtagtaatggtgtatgtccttgactac

SEQ ID NO: 226 - DNA, 39 bp, Artificial Sequence
  Description of Artificial Sequence: Synthetic oligonucleotide
gatccggacggtgactactactactacggtatggacgtc

SEQ ID NO: 227 - DNA, 45 bp, Artificial Sequence
  Description of Artificial Sequence: Synthetic oligonucleotide
gttcgtatagcaggtgattactactactactacggtatggacgtc

SEQ ID NO: 228 - DNA, 33 bp, Artificial Sequence
  Description of Artificial Sequence: Synthetic oligonucleotide
gatcgggtgctaagctactacgctatggccgtc

SEQ ID NO: 229 - DNA, 45 bp, Artificial Sequence
  Description of Artificial Sequence: Synthetic oligonucleotide
gatagggcagcagctggtctccactattattacggtatggacgtc

SEQ ID NO: 230 - DNA, 51 bp, Artificial Sequence
  Description of Artificial Sequence: Synthetic oligonucleotide
gagaatattgtagtaataccagctgctatattcgcgggttggttcgacccc

SEQ ID NO: 231 - DNA, 33 bp, Artificial Sequence
  Description of Artificial Sequence: Synthetic oligonucleotide
cgggcaagtcaggacattagatatgatttaggc

SEQ ID NO: 232 - DNA, 48 bp, Artificial Sequence
  Description of Artificial Sequence: Synthetic oligonucleotide
aggtctagtcagagcctcctgtattataatggattcacctatttggat

SEQ ID NO: 233 - DNA, 36 bp, Artificial Sequence
  Description of Artificial Sequence: Synthetic oligonucleotide
agggccagtcagaattttgacagcagctccttagcc

SEQ ID NO: 234 - DNA, 36 bp, Artificial Sequence
  Description of Artificial Sequence: Synthetic oligonucleotide
agggccagtcagaattttgacagcagttacttagcc

SEQ ID NO: 235 - DNA, 36 bp, Artificial Sequence
  Description of Artificial Sequence: Synthetic oligonucleotide
agggccagtcagagtgttagcggcaactacttggcc

SEQ ID NO: 236 - DNA, 36 bp, Artificial Sequence
  Description of Artificial Sequence: Synthetic oligonucleotide
agggccagtcagagtgtgagcagtacctacttagcc

SEQ ID NO: 237 - DNA, 36 bp, Artificial Sequence
  Description of Artificial Sequence: Synthetic oligonucleotide
agggccagtcagaatttcgacagcaactacttagcc

SEQ ID NO: 238 - DNA, 33 bp, Artificial Sequence
  Description of Artificial Sequence: Synthetic oligonucleotide
agggccagtcagagtgttaacagcaacttagcc

SEQ ID NO: 239 - DNA, 33 bp, Artificial Sequence
  Description of Artificial Sequence: Synthetic oligonucleotide
gggggaaacaacattggaagtgaaagtgtgcac

SEQ ID NO: 240 - DNA, 33 bp, Artificial Sequence
  Description of Artificial Sequence: Synthetic oligonucleotide
gggggaaacaacattggaagtcaaagtgtgcac

SEQ ID NO: 241 - DNA, 33 bp, Artificial Sequence
  Description of Artificial Sequence: Synthetic oligonucleotide
cgggcgagtcagggtattagcatctggttagcc

SEQ ID NO: 242 - DNA, 48 bp, Artificial Sequence
  Description of Artificial Sequence: Synthetic oligonucleotide
aagtctagtcagagcctcctacagagtgatggaaagacctatttgtat

SEQ ID NO: 243 - DNA, 48 bp, Artificial Sequence
  Description of Artificial Sequence: Synthetic oligonucleotide
aggtctagtcagagcctcctgcatagtaatggatacaactttttggat

SEQ ID NO: 244 - DNA, 21 bp, Artificial Sequence
  Description of Artificial Sequence: Synthetic oligonucleotide
gctgcatccagtttgcaaagt

SEQ ID NO: 245 - DNA, 21 bp, Artificial Sequence
  Description of Artificial Sequence: Synthetic oligonucleotide
ttgggttctaatcgggcctcc

SEQ ID NO: 246 - DNA, 21 bp, Artificial Sequence
  Description of Artificial Sequence: Synthetic oligonucleotide
ggtgcatccagcagggccact

SEQ ID NO: 247 - DNA, 21 bp, Artificial Sequence
  Description of Artificial Sequence: Synthetic oligonucleotide
ggtacatccagcagggccact

SEQ ID NO: 248 - DNA, 21 bp, Artificial Sequence
  Description of Artificial Sequence: Synthetic oligonucleotide
ggtgtatccaccagggccact

SEQ ID NO: 249 - DNA, 21 bp, Artificial Sequence
  Description of Artificial Sequence: Synthetic oligonucleotide
gatgatagcgaccggccctca

SEQ ID NO: 250 - DNA, 21 bp, Artificial Sequence
  Description of Artificial Sequence: Synthetic oligonucleotide
gaagtttccaaccgattctct

SEQ ID NO: 251 - DNA, 21 bp, Artificial Sequence
  Description of Artificial Sequence: Synthetic oligonucleotide
ttgggttctgatcgggcctcc

SEQ ID NO: 252 - DNA, 27 bp, Artificial Sequence
  Description of Artificial Sequence: Synthetic oligonucleotide
ctacagcataatagttaccctctcact

SEQ ID NO: 253 - DNA, 27 bp, Artificial Sequence
  Description of Artificial Sequence: Synthetic oligonucleotide
atgcagtctctgcaaactccattcact

SEQ ID NO: 254 - DNA, 27 bp, Artificial Sequence
  Description of Artificial Sequence: Synthetic oligonucleotide
cagcagtgtggtagctcaccgctcact

SEQ ID NO: 255 - DNA, 27 bp, Artificial Sequence
  Description of Artificial Sequence: Synthetic oligonucleotide
cagcagtatggtggctcaccgctcact

SEQ ID NO: 256 - DNA, 27 bp, Artificial Sequence
  Description of Artificial Sequence: Synthetic oligonucleotide
cagcagtatggtagcgcaccgctcact

SEQ ID NO: 257 - DNA, 24 bp, Artificial Sequence
  Description of Artificial Sequence: Synthetic oligonucleotide
cagcagtatggaagttcattcact

SEQ ID NO: 258 - DNA, 27 bp, Artificial Sequence
  Description of Artificial Sequence: Synthetic oligonucleotide
cagcagtatggtagctcaccgctcact

SEQ ID NO: 259 - DNA, 27 bp, Artificial Sequence
  Description of Artificial Sequence: Synthetic oligonucleotide
cagcagtataataactggcctccgacg

SEQ ID NO: 260 - DNA, 33 bp, Artificial Sequence
  Description of Artificial Sequence: Synthetic oligonucleotide
caggtgtgggatggtaatagtgatcatgtggta

SEQ ID NO: 261 - DNA, 33 bp, Artificial Sequence
  Description of Artificial Sequence: Synthetic oligonucleotide
caggtgtgggataatactagtgatcatgtggta

SEQ ID NO: 262 - DNA, 33 bp, Artificial Sequence
  Description of Artificial Sequence: Synthetic oligonucleotide
caggtgtgggatagtagtagtgatcatgtggta

SEQ ID NO: 263 - DNA, 27 bp, Artificial Sequence
  Description of Artificial Sequence: Synthetic oligonucleotide
caacaggctaacgatttcccgatcacc

SEQ ID NO: 264 - DNA, 27 bp, Artificial Sequence
  Description of Artificial Sequence: Synthetic oligonucleotide
atgcaaagtatacagcttcctcggacg

SEQ ID NO: 265 - DNA, 27 bp, Artificial Sequence
  Description of Artificial Sequence: Synthetic oligonucleotide
atgcaagctctacaaactccgtgcagt

SEQ ID NO: 266 - DNA, 27 bp, Artificial Sequence
  Description of Artificial Sequence: Synthetic oligonucleotide
cagcagtctggtagctcacctctcact

SEQ ID NO: 267 - protein, 9 aa, Artificial Sequence
  Description of Artificial Sequence: Synthetic peptide
LQHNSYPLT

SEQ ID NO: 268 - protein, 9 aa, Artificial Sequence
  Description of Artificial Sequence: Synthetic peptide
MQSLQTPFT

SEQ ID NO: 269 - protein, 9 aa, Artificial Sequence
  Description of Artificial Sequence: Synthetic peptide
QQYNNWPPT

SEQ ID NO: 270 - protein, 9 aa, Artificial Sequence
  Description of Artificial Sequence: Synthetic peptide
MQSIQLPRT

SEQ ID NO: 271 - protein, 9 aa, Artificial Sequence
  Description of Artificial Sequence: Synthetic peptide
QQANDFPIT

SEQ ID NO: 272 - protein, 9 aa, Artificial Sequence
  Description of Artificial Sequence: Synthetic peptide
MQALQTPCS

SEQ ID NO: 273 - protein, 11 aa, Artificial Sequence
  Description of Artificial Sequence: Synthetic peptide
QVWDGNSDHVV

SEQ ID NO: 274 - protein, 11 aa, Artificial Sequence
  Description of Artificial Sequence: Synthetic peptide
QVWDNTSDHVV

SEQ ID NO: 275 - protein, 11 aa, Artificial Sequence
  Description of Artificial Sequence: Synthetic peptide
QVWDSSSDHVV

SEQ ID NO: 276 - protein, 11 aa, Artificial Sequence
  Description of Artificial Sequence: Synthetic peptide
  MOD_RES (5)..(5): Gly, Ser or Asn
  MOD_RES (6)..(6): Ser, Thr or Asn
QVWDXXSDHVV

SEQ ID NO: 277 - protein, 9 aa, Artificial Sequence
  Description of Artificial Sequence: Synthetic peptide
QQCGSSPLT

SEQ ID NO: 278 - protein, 9 aa, Artificial Sequence
  Description of Artificial Sequence: Synthetic peptide
QQYGGSPLT

SEQ ID NO: 279 - protein, 9 aa, Artificial Sequence
  Description of Artificial Sequence: Synthetic peptide
QQYGSAPLT

SEQ ID NO: 280 - protein, 8 aa, Artificial Sequence
  Description of Artificial Sequence: Synthetic peptide
QQYGSSFT

SEQ ID NO: 281 - protein, 9 aa, Artificial Sequence
  Description of Artificial Sequence: Synthetic peptide
QQYGSSPLT

SEQ ID NO: 282 - protein, 9 aa, Artificial Sequence
  Description of Artificial Sequence: Synthetic peptide
QQSGSSPLT

SEQ ID NO: 283 - protein, 9 aa, Artificial Sequence
  Description of Artificial Sequence: Synthetic peptide
  MOD_RES (3)..(3): Cys, Tyr or Ser
  MOD_RES (5)..(5): Ser or Gly
  MOD_RES (6)..(6): Ser or Ala
  MOD_RES (7)..(7): Pro or Phe
  MOD_RES (8)..(8): Leu or absent
QQXGXXXXT

SEQ ID NO: 284 - protein, 7 aa, Artificial Sequence
  Description of Artificial Sequence: Synthetic peptide
AASSLQS

SEQ ID NO: 285 - protein, 7 aa, Artificial Sequence
  Description of Artificial Sequence: Synthetic peptide
GVSTRAT

SEQ ID NO: 286 - protein, 7 aa, Artificial Sequence
  Description of Artificial Sequence: Synthetic peptide
DDSDRPS

SEQ ID NO: 287 - protein, 7 aa, Artificial Sequence
  Description of Artificial Sequence: Synthetic peptide
EVSNRFS

SEQ ID NO: 288 - protein, 7 aa, Artificial Sequence
  Description of Artificial Sequence: Synthetic peptide
LGSNRAS

SEQ ID NO: 289 - protein, 7 aa, Artificial Sequence
  Description of Artificial Sequence: Synthetic peptide
LGSDRAS

SEQ ID NO: 290 - protein, 7 aa, Artificial Sequence
  Description of Artificial Sequence: Synthetic peptide
  MOD_RES (4)..(4): Asn or Asp
LGSXRAS

SEQ ID NO: 291 - protein, 7 aa, Artificial Sequence
  Description of Artificial Sequence: Synthetic peptide
GASSRAT

SEQ ID NO: 292 - protein, 7 aa, Artificial Sequence
  Description of Artificial Sequence: Synthetic peptide
GTSSRAT

SEQ ID NO: 293 - protein, 7 aa, Artificial Sequence
  Description of Artificial Sequence: Synthetic peptide
GASFRAT

SEQ ID NO: 294 - protein, 7 aa, Artificial Sequence
  Description of Artificial Sequence: Synthetic peptide
  MOD_RES (2)..(2): Ala or Thr
  MOD_RES (4)..(4): Ser or Phe
GXSXRAT

SEQ ID NO: 295 - protein, 11 aa, Artificial Sequence
  Description of Artificial Sequence: Synthetic peptide
RASQSVNSNLA

SEQ ID NO: 296 - protein, 11 aa, Artificial Sequence
  Description of Artificial Sequence: Synthetic peptide
RASQDIRYDLG

SEQ ID NO: 297 - protein, 11 aa, Artificial Sequence
  Description of Artificial Sequence: Synthetic peptide
RASQGISIWLA

SEQ ID NO: 298 - protein, 16 aa, Artificial Sequence
  Description of Artificial Sequence: Synthetic peptide
KSSQSLLQSDGKTYLY

SEQ ID NO: 299 - protein, 12 aa, Artificial Sequence
  Description of Artificial Sequence: Synthetic peptide
RASQNFDSSSLA

SEQ ID NO: 300 - protein, 12 aa, Artificial Sequence
  Description of Artificial Sequence: Synthetic peptide
RASQNFDSSYLA

SEQ ID NO: 301 - protein, 12 aa, Artificial Sequence
  Description of Artificial Sequence: Synthetic peptide
RASQSVSGNYLA

SEQ ID NO: 302 - protein, 12 aa, Artificial Sequence
  Description of Artificial Sequence: Synthetic peptide
RASQSVSGTYLA

SEQ ID NO: 303 - protein, 12 aa, Artificial Sequence
  Description of Artificial Sequence: Synthetic peptide
RASQNFDSNYLA

SEQ ID NO: 304 - protein, 12 aa, Artificial Sequence
  Description of Artificial Sequence: Synthetic peptide
  MOD_RES (5)..(5): Asn or Ser
  MOD_RES (6)..(6): Val or Phe
  MOD_RES (7)..(7): Asp or Ser
  MOD_RES (8)..(8): Gly or Ser
  MOD_RES (9)..(9): Ser, Asn or Thr
  MOD_RES (10)..(10): Ser or Tyr
RASQXXXXXXLA

SEQ ID NO: 305 - protein, 11 aa, Artificial Sequence
  Description of Artificial Sequence: Synthetic peptide
GGNNIGSESVH

SEQ ID NO: 306 - protein, 11 aa, Artificial Sequence
  Description of Artificial Sequence: Synthetic peptide
GGNNIGSQSVH

SEQ ID NO: 307 - protein, 11 aa, Artificial Sequence
  Description of Artificial Sequence: Synthetic peptide
  MOD_RES (8)..(8): Glu or Gln
GGNNIGSXSVH

SEQ ID NO: 308 - protein, 16 aa, Artificial Sequence
  Description of Artificial Sequence: Synthetic peptide
RSSQSLLYYNGFTYLD

SEQ ID NO: 309 - protein, 16 aa, Artificial Sequence
  Description of Artificial Sequence: Synthetic peptide
RSSQSLLHSNGYNFLD

SEQ ID NO: 310 - protein, 16 aa, Artificial Sequence
  Description of Artificial Sequence: Synthetic peptide
  MOD_RES (8)..(8): Tyr or His
  MOD_RES (9)..(9): Tyr or Ser
  MOD_RES (12)..(12): Phe or Tyr
  MOD_RES (13)..(13): Thr or Asn
  MOD_RES (14)..(14): Tyr or Phe
RSSQSLLXXNGXXXLD

SEQ ID NO: 311 - protein, 19 aa, Artificial Sequence
  Description of Artificial Sequence: Synthetic peptide
IVVVPAAIQSYYYYYGMGV

SEQ ID NO: 312 - protein, 13 aa, Artificial Sequence
  Description of Artificial Sequence: Synthetic peptide
DPDGDYYYYGMDV

SEQ ID NO: 313 - protein, 16 aa, Artificial Sequence
  Description of Artificial Sequence: Synthetic peptide
TYSSGWYVWDYYGMDV

SEQ ID NO: 314 - protein, 11 aa, Artificial Sequence
  Description of Artificial Sequence: Synthetic peptide
DRVLSYYAMAV

SEQ ID NO: 315 - protein, 15 aa, Artificial Sequence
  Description of Artificial Sequence: Synthetic peptide
VRIAGDYYYYYGMDV

SEQ ID NO: 316 - protein, 17 aa, Artificial Sequence
  Description of Artificial Sequence: Synthetic peptide
ENIVVIPAAIFAGWFDP

SEQ ID NO: 317 - protein, 15 aa, Artificial Sequence
  Description of Artificial Sequence: Synthetic peptide
DRAAAGLHYYYGMDV

SEQ ID NO: 318 - protein, 14 aa, Artificial Sequence
  Description of Artificial Sequence: Synthetic peptide
ILLLGAYYYYGMDV

SEQ ID NO: 319 - protein, 14 aa, Artificial Sequence
  Description of Artificial Sequence: Synthetic peptide
ILLVGAYYYCGMDV

SEQ ID NO: 320 - protein, 13 aa, Artificial Sequence
  Description of Artificial Sequence: Synthetic peptide
VVTGGYYYDGMDV

SEQ ID NO: 321 - protein, 14 aa, Artificial Sequence
  Description of Artificial Sequence: Synthetic peptide
SVVTGGYYYDGMDV

SEQ ID NO: 322 - protein, 14 aa, Artificial Sequence
  Description of Artificial Sequence: Synthetic peptide
  MOD_RES (1)..(1): Ile, Val or Ser
  MOD_RES (2)..(2): Leu or Val
  MOD_RES (3)..(3): Leu, Thr or Val
  MOD_RES (4)..(4): Leu, Val, Gly or Thr
  MOD_RES (6)..(6): Ala, Gly or absent
  MOD_RES (10)..(10): Tyr, Cys or Asp
XXXXGXYYYXGMDV

SEQ ID NO: 323 - protein, 12 aa, Artificial Sequence
  Description of Artificial Sequence: Synthetic peptide
SLIVVIVYALDH

SEQ ID NO: 324 - protein, 12 aa, Artificial Sequence
  Description of Artificial Sequence: Synthetic peptide
SLIVVIVYALDY

SEQ ID NO: 325 - protein, 12 aa, Artificial Sequence
  Description of Artificial Sequence: Synthetic peptide
SLIVVMVYVLDY

SEQ ID NO: 326 - protein, 12 aa, Artificial Sequence
  Description of Artificial Sequence: Synthetic peptide
  MOD_RES (6)..(6): Ile or Met
  MOD_RES (9)..(9): Ala or Val
  MOD_RES (12)..(12): His or Tyr
SLIVVXVYXLDX

SEQ ID NO: 327 - protein, 17 aa, Artificial Sequence
  Description of Artificial Sequence: Synthetic peptide
GFDPEDGETIYAQKFQG

SEQ ID NO: 328 - protein, 19 aa, Artificial Sequence
  Description of Artificial Sequence: Synthetic peptide
RIKSKTDGGTTDYAAPVKG

SEQ ID NO: 329 - protein, 16 aa, Artificial Sequence
  Description of Artificial Sequence: Synthetic peptide
RIYTSGSTNYNPSLKS

SEQ ID NO: 330 - protein, 18 aa, Artificial Sequence
  Description of Artificial Sequence: Synthetic peptide
RIKSKDGGTTDYAAPVKG

SEQ ID NO: 331 - protein, 16 aa, Artificial Sequence
  Description of Artificial Sequence: Synthetic peptide
HIFSNDEKSYSTSLKS

SEQ ID NO: 332 - protein, 16 aa, Artificial Sequence
  Description of Artificial Sequence: Synthetic peptide
HIFSNDEKSYSTSLKN

SEQ ID NO: 333 - protein, 16 aa, Artificial Sequence
  Description of Artificial Sequence: Synthetic peptide
  MOD_RES (16)..(16): Ser or Asn
HIFSNDEKSYSTSLKX

SEQ ID NO: 334 - protein, 17 aa, Artificial Sequence
  Description of Artificial Sequence: Synthetic peptide
GISGSGVSTHYADSVKG

SEQ ID NO: 335 - protein, 17 aa, Artificial Sequence
  Description of Artificial Sequence: Synthetic peptide
GISGSGVSTYYADSVKG

SEQ ID NO: 336 - protein, 17 aa, Artificial Sequence
  Description of Artificial Sequence: Synthetic peptide
AISGSGVSTYYADSVKG

SEQ ID NO: 337 - protein, 17 aa, Artificial Sequence
  Description of Artificial Sequence: Synthetic peptide
AISGSGVSTNYADSVKG

SEQ ID NO: 338 - protein, 17 aa, Artificial Sequence
  Description of Artificial Sequence: Synthetic peptide
  MOD_RES (1)..(1): Gly or Ala
  MOD_RES (10)..(10): His, Tyr or Asn
XISGSGVSTXYADSVKG

SEQ ID NO: 339 - protein, 17 aa, Artificial Sequence
  Description of Artificial Sequence: Synthetic peptide
VIWYDGSDKYYADSVKG

SEQ ID NO: 340 - protein, 17 aa, Artificial Sequence
  Description of Artificial Sequence: Synthetic peptide
VIWYDGSIKYYGDSVKG

SEQ ID NO: 341 - protein, 17 aa, Artificial Sequence
  Description of Artificial Sequence: Synthetic peptide
  MOD_RES (8)..(8): Asp or Ile
  MOD_RES (12)..(12): Ala or Gly
VIWYDGSXKYYXDSVKG

SEQ ID NO: 342 - protein, 16 aa, Artificial Sequence
  Description of Artificial Sequence: Synthetic peptide
NIYYSGSTYYNPSLKS

SEQ ID NO: 343 - protein, 16 aa, Artificial Sequence
  Description of Artificial Sequence: Synthetic peptide
RIYTSGSTYYNPSLKS

SEQ ID NO: 344 - protein, 16 aa, Artificial Sequence
  Description of Artificial Sequence: Synthetic peptide
  MOD_RES (1)..(1): Asn or Arg
  MOD_RES (4)..(4): Tyr or Thr
  MOD_RES (9)..(9): Tyr or Asn
XIYXSGSTXYNPSLKS

SEQ ID NO: 345 - protein, 5 aa, Artificial Sequence
  Description of Artificial Sequence: Synthetic peptide
DLSMH

SEQ ID NO: 346 - protein, 5 aa, Artificial Sequence
  Description of Artificial Sequence: Synthetic peptide
DAWMS

SEQ ID NO: 347 - protein, 5 aa, Artificial Sequence
  Description of Artificial Sequence: Synthetic peptide
TYAMS

SEQ ID NO: 348 - protein, 5 aa, Artificial Sequence
  Description of Artificial Sequence: Synthetic peptide
SYFWS

SEQ ID NO: 349 - protein, 7 aa, Artificial Sequence
  Description of Artificial Sequence: Synthetic peptide
SGGYNWS

SEQ ID NO: 350 - protein, 7 aa, Artificial Sequence
  Description of Artificial Sequence: Synthetic peptide
NARMGVS

SEQ ID NO: 351 - protein, 7 aa, Artificial Sequence
  Description of Artificial Sequence: Synthetic peptide
NARMGVN

SEQ ID NO: 352 - protein, 7 aa, Artificial Sequence
  Description of Artificial Sequence: Synthetic peptide
  MOD_RES (7)..(7): Ser or Asn
NARMGVX

SEQ ID NO: 353 - protein, 5 aa, Artificial Sequence
  Description of Artificial Sequence: Synthetic peptide
SYGIH

SEQ ID NO: 354 - protein, 5 aa, Artificial Sequence
  Description of Artificial Sequence: Synthetic peptide
NYGIH

SEQ ID NO: 355 - protein, 5 aa, Artificial Sequence
  Description of Artificial Sequence: Synthetic peptide
  MOD_RES (1)..(1): Ser or Asn
XYGIH

SEQ ID NO: 356 - protein, 822 aa, Homo sapiens [sequence omitted]

SEQ ID NO: 357 - protein, 822 aa, Mus musculus
MWGWKCLLFWAVLVTATLCTARPAPTLPEQAQPWGVPVEVESLLVHPGDLLQLRCRLRDDVQSINWLRDGVQLVESNRTRITGEEVEVRDSIPADSGLYACVTSSPSGSDTTYFSVNVSDALPSSEDDDDDDDSSSEEKETDNTKPNRRPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERPAVMTSPLYLEIIIYCTGAFLISCMLGSVIIYKMKSGTKKSDFHSQMAVHKLAKSIPLRRQVTVSADSSASMNSGVLLVRPSRLSSSGTPMLAGVSEYELPEDPRWELPRDRLVLGKPLGEGCFGQVVLAEAIGLDKDKPNRVTKVAVKMLKSDATEKDLSDLISEMEMMKMIGKHKNIINLLGACTQDGPLYVIVEYASKGNLREYLQARRPPGLEYCYNPSHNPEEQLSSKDLVSCAYQVARGMEYLASKKCIHRDLAARNVLVTEDNVMKIADFGLARDIHHIDYYKKTTNGRLPVKWMAPEALFDRIYTHQSDVWSFGVLLWEIFTLGGSPYPGVPVEELFKLLKEGHRMDKPSNCTNELYMMMRDCWHAVPSQRPTFKQLVEDLDRIVALTSNQEYLDLSIPLDQYSPSFPDTRSSTCSSGEDSVFSHEPLPEEPCLPRHPTQLANSGLKRR

SEQ ID NO: 358 - protein, 822 aa, Artificial Sequence
  Description of Artificial Sequence: Synthetic consensus sequence
  MOD_RES (3)..(3): Ser or Gly
  MOD_RES (36)..(36): Ala or Val
  MOD_RES (43)..(43): Phe or Leu
  MOD_RES (74)..(74): Ala or Val
  MOD_RES (89)..(89): Gln or Arg
  MOD_RES (149)..(149): Met or Arg
  MOD_RES (812)..(812): Ala or Thr
  MOD_RES (817)..(817): Gly or Ser
MWXWKCLLFWAVLVTATLCTARPAPTLPEQAQPWGXPVEVESXLVHPGDLLQLRCRLRDDVQSINWLRDGVQLXESNRTRITGEEVEVXDSIPADSGLYACVTSSPSGSDTTYFSVNVSDALPSSEDDDDDDDSSSEEKETDNTKPNRXPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERPAVMTSPLYLEIIIYCTGAFLISCMLGSVIIYKMKSGTKKSDFHSQMAVHKLAKSIPLRRQVTVSADSSASMNSGVLLVRPSRLSSSGTPMLAGVSEYELPEDPRWELPRDRLVLGKPLGEGCFGQVVLAEAIGLDKDKPNRVTKVAVKMLKSDATEKDLSDLISEMEMMKMIGKHKNIINLLGACTQDGPLYVIVEYASKGNLREYLQARRPPGLEYCYNPSHNPEEQLSSKDLVSCAYQVARGMEYLASKKCIHRDLAARNVLVTEDNVMKIADFGLARDIHHIDYYKKTTNGRLPVKWMAPEALFDRIYTHQSDVWSFGVLLWEIFTLGGSPYPGVPVEELFKLLKEGHRMDKPSNCTNELYMMMRDCWHAVPSQRPTFKQLVEDLDRIVALTSNQEYLDLSIPLDQYSPSFPDTRSSTCSSGEDSVFSHEPLPEEPCLPRHPXQLANXGLKRR

SEQ ID NO: 359 - protein, 1044 aa, Homo sapiens; identical to SEQ ID NO: 7

SEQ ID NO: 360 - protein, 1043 aa, Mus musculus
MKTGCAAGSPGNEWIFFSSDERNTRSRKTMSNRALQRSAVLSAFVLLRAVTGFSGDGKAIWDKKQYVSPVNPSQLFLYDTFPKNFSWGVGTGAFQVEGSWKTDGRGPSIWDRYVYSHLRGVNGTDRSTDSYIFLEKDLLALDFLGVSFYQFSISWPRLFPNGTVAAVNAQGLRYYRALLDSLVLRNIEPIVTLYHWDLPLTLQEEYGGWKNATMIDLFNDYATYCFQTFGDRVKYWITIHNPYLVAWHGFGTGMHAPGEKGNLTAVYTVGHNLIKAHSKVWHNYDKNFRPHQKGWLSITLGSHWIEPNRTDNMEDVINCQHSMSSVLGWFANPIHGDGDYPEFMKTGAMIPEFSEAEKEEVRGTADFFAFSFGPNNFRPSNTVVKMGQNVSLNLRQVLNWIKLEYDDPQILISENGWFTDSYIKTEDTTAIYMMKNFLNQVLQAIKFDEIRVFGYTAWTLLDGFEWQDAYTTRRGLFYVDFNSEQKERKPKSSAHYYKQIIQDNGFPLKESTPDMKGRFPCDFSWGVTESVLKPEFTVSSPQFTDPHLYVWNVTGNRLLYRVEGVRLKTRPSQCTDYVSIKKRVEMLAKMKVTHYQFALDWTSILPTGNLSKVNRQVLRYYRCVVSEGLKLGVFPMVTLYHPTHSHLGLPLPLLSSGGWLNMNTAKAFQDYAELCFRELGDLVKLWITINEPNRLSDMYNRTSNDTYRAAHNLMIAHAQVWHLYDRQYRPVQHGAVSLSLHCDWAEPANPFVDSHWKAAERFLQFEIAWFADPLFKTGDYPSVMKEYIASKNQRGLSSSVLPRFTAKESRLVKGTVDFYALNHFTTRFVIHKQLNTNRSVADRDVQFLQDITRLSSPSRLAVTPWGVRKLLAWIRRNYRDRDIYITANGIDDLALEDDQIRKYYLEKYVQEALKAYLIDKVKIKGYYAFKLTEEKSKPRFGFFTSDFRAKSSVQFYSKLISSSGLPAENRSPACGQPAEDTDCTICSFLVEKKPLIFFGCCFISTLAVLLSITVFHHQKRRKFQKARNLQNIPLKKGHSRVFS

SEQ ID NO: 361 - protein, 1045 aa, Artificial Sequence
  Description of Artificial Sequence: Synthetic consensus sequence
  MOD_RES (3)..(3): Pro or Thr
  MOD_RES (22)..(22): Ile or Arg
  MOD_RES (23)..(23): Thr or Asn
  MOD_RES (26)..(26): Tyr or Ser
  MOD_RES (28)..(28): Asn or Lys
  MOD_RES (33)..(33): Gly or Arg
  MOD_RES (39)..(39): Val or Ala
  MOD_RES (44)..(44): Leu or Phe
  MOD_RES (62)..(62): Ser or Asp
  MOD_RES (64)..(64): Asn or Lys
  MOD_RES (65)..(65): Pro or Gln
  MOD_RES (66)..(66): Asn or Tyr
  MOD_RES (67)..(67): Phe or Val
  MOD_RES (72)..(72): Glu or Pro
  MOD_RES (86)..(86): Phe or Ser
  MOD_RES (94)..(94): Leu or Phe
  MOD_RES (102)..(102): Lys or Thr
  MOD_RES (112)..(112): His or Arg
  MOD_RES (120)..(120): Asn or Gly
  MOD_RES (122)..(122): Ser or Asn
  MOD_RES (123)..(123): Ser or Gly
  MOD_RES (125)..(125): Asn or Asp
  MOD_RES (126)..(126): Gly or Arg
  MOD_RES (139)..(139): Ser or Leu
  MOD_RES (161)..(161): Asp or Asn
  MOD_RES (163)..(163): Ile or Thr
  MOD_RES (165)..(165): Thr or Ala
  MOD_RES (166)..(167): Val or Ala
  MOD_RES (170)..(170): Lys or Gln
  MOD_RES (173)..(173): Gln or Arg
  MOD_RES (176)..(176): Ser or Arg
  MOD_RES (177)..(177): Thr or Ala
  MOD_RES (201)..(201): Ala or Thr
  MOD_RES (205)..(205): Lys or Glu
  MOD_RES (212)..(212): Asp or Ala
  MOD_RES (228)..(228): Met or Thr
  MOD_RES (264)..(264): Ala or Thr
  MOD_RES (285)..(285): Asn or Asp
  MOD_RES (286)..(286): Thr or Lys
  MOD_RES (287)..(287): His or Asn
  MOD_RES (313)..(313): Thr or Met
  MOD_RES (314)..(314): Met or Glu
  MOD_RES (317)..(317): Phe or Ile
  MOD_RES (318)..(318): Lys or Asn
  MOD_RES (321)..(321): Gln or His
  MOD_RES (324)..(324): Val or Ser
  MOD_RES (343)..(343): Gly or Phe
  MOD_RES (346)..(346): Lys or Thr
  MOD_RES (347)..(347): Lys or Gly
  MOD_RES (348)..(348): Leu or absent
  MOD_RES (349)..(349): Phe or absent
  MOD_RES (354)..(354): Ile or glu
  MOD_RES (361)..(361): His or Glu
  MOD_RES (382)..(382): Leu or Ser
  MOD_RES (386)..(386): Ala or Val
  MOD_RES (398)..(398): Glu or Gln
  MOD_RES (399)..(399): Ala or Val
  MOD_RES (408)..(409): Asn or Asp
  MOD_RES (411)..(411): Arg or Gln
  MOD_RES (424)..(424): Arg or Tyr
  MOD_RES (441)..(441): Ser or Asn
  MOD_RES (449)..(449): Leu or Phe
  MOD_RES (474)..(474): Ile or Thr
  MOD_RES (486)..(486): Lys or Glu
  MOD_RES (504)..(504): Arg or Gln
  MOD_RES (509)..(509): Ser or Pro
  MOD_RES (518)..(518): Gln or Lys
  MOD_RES (520)..(520): Gln or Arg
  MOD_RES (538)..(538): Ser or Phe
  MOD_RES (539)..(539): Val or Thr
  MOD_RES (540)..(540): Ala or Val
  MOD_RES (555)..(555): Ala or Val
  MOD_RES (581)..(581): Asn or Ser
  MOD_RES (585)..(585): Gln or Arg
  MOD_RES (598)..(598): Arg or Gln
  MOD_RES (604)..(604): Ala or Thr
  MOD_RES (614)..(614): Ala or Lys
  MOD_RES (619)..(619): Ala or Val
  MOD_RES (636)..(636): Ser or Phe
  MOD_RES (637)..(637): Ala or Pro
  MOD_RES (653)..(653): Glu or Leu
  MOD_RES (657)..(657): His or Ser
  MOD_RES (659)..(659): Asp or Gly
  MOD_RES (664)..(664): Pro or Met
  MOD_RES (665)..(665): Ser or Asn
  MOD_RES (668)..(668): Glu or Lys
  MOD_RES (672)..(672): Ala or Asp
  MOD_RES (675)..(675): Gly or Glu
  MOD_RES (679)..(679): Gln or Arg
  MOD_RES (705)..(705): Gly or Ser
  MOD_RES (710)..(710): Gly or Arg
  MOD_RES (721)..(721): Leu or Gln
  MOD_RES (722)..(722): Ala or Val
  MOD_RES (724)..(724): Arg or His
  MOD_RES (733)..(733): Ser or Val
  MOD_RES (735)..(735): Arg or His
  MOD_RES (744)..(744): Ala or Cys
  MOD_RES (754)..(754): Ala or Val
  MOD_RES (785)..(785): Ala or Val
  MOD_RES (794)..(794): His or Asn
  MOD_RES (795)..(795): Arg or Gln
  MOD_RES (802)..(802): Ala or Val
  MOD_RES (806)..(806): Leu or Phe
  MOD_RES (808)..(808): Glu or Ala
  MOD_RES (809)..(809): Ala or Lys
  MOD_RES (811)..(811): Arg or Ser
  MOD_RES (821)..(821): Cys or Tyr
  MOD_RES (834)..(834): Glu or Lys
  MOD_RES (837)..(837): Ala or Asn
  MOD_RES (838)..(838): Gly or Thr
  MOD_RES (839)..(839): Ser or Asn
  MOD_RES (841)..(841): Tyr or Ser
  MOD_RES (842)..(842): Asp or Val
  MOD_RES (865)..(865): Ile or Thr
  MOD_RES (874)..(874): Arg or Ala
  MOD_RES (881)..(881): Gly or Arg
  MOD_RES (883)..(883): Met or Arg
  MOD_RES (890)..(890): Ser or Asn
  MOD_RES (895)..(895): Gln or Leu
  MOD_RES (901)..(901): Arg or Gln
  MOD_RES (908)..(908): Gly or Glu
  MOD_RES (914)..(914): Val or Ala
  MOD_RES (934)..(934): Ala or Thr
  MOD_RES (959)..(959): Asn or Ser
  MOD_RES (965)..(965): Arg or Ser
  MOD_RES (967)..(967): Phe or Leu
  MOD_RES (969)..(969): Phe or Ala
  MOD_RES (972)..(972): Ser or Arg
  MOD_RES (974)..(974): Ser or Pro
  MOD_RES (975)..(975): Arg or Ala
  MOD_RES (977)..(977): Ser or Gly
  MOD_RES (979)..(979): Thr or Pro
  MOD_RES (980)..(980): Gln or Ala
  MOD_RES (982)..(982): Asn or Asp
  MOD_RES (989)..(989): Leu or Ser
  MOD_RES (993)..(993): Gln or Glu
  MOD_RES (1000)..(1000): Leu or Phe
  MOD_RES (1005)..(1005): Phe or Ile
  MOD_RES (1009)..(1009): Val or Ala
  MOD_RES (1015)..(1015): Ala or Thr
  MOD_RES (1018)..(1018): Gln or His
  MOD_RES (1019)..(1019): Arg or His
  MOD_RES (1026)..(1026): Trp or Gln
  MOD_RES (1033)..(1033): His or Asn
  MOD_RES (1040)..(1040): Lys or His
  MOD_RES (1041)..(1041): Arg or Ser
  MOD_RES (1042)..(1042): Val or Arg
  MOD_RES (1044)..(1044): Ser or Phe
  MOD_RES (1045)..(1045): Ser or absent
MKXGCAAGSPGNEWIFFSSDEXXTRXRXTMSNXALQRSXILSAXILLRAVTGFSGDGKAIWXKXXXXSPVNXSQLFLYDTFPKNFXWGIGTGAXQVEGSWKXDGKGPSIWDXFIHSHLKXVXXTXXSSDSYIFLEKDLXALDFIGVSFYQFSISWPRLFPXGXVXXXNAXGLXYYXXLLDALVLRNIEPIVTLYHWDLPLXLQEXYGGWKNXTIIDIFNDYATYCFQXFGDRVKYWITIHNPYLVAWHGFGTGMHAPGEKGNLXAVYTVGHNLIKAHSKVWHNYXXXFRPHQKGWLSITLGSHWIEPNRSDNXXDIXXCQXSMXSVLGWFANPIHGDGDYPEXMKXXXXAMIPXFSEAEKXEMRGTADFFAFSFGPNNFKPXNTMXKMGQNVSLNLRXXLNWIKLEYXXPXILIAENGWFTDSXIKTEDTTAIYMMKNFLXQVLQAIKXDEIRVFGYTAWSLLDGFEWQDAYTXRRGLFYVDFNSXQKERKPKSSAHYYKQIIXDNGFXLKESTPDMXGXFPCDFSWGVTESVLKPEXXXSSPQFSDPHLYVWNXTGNRLLHRVEGVRLKTRPAQCTDFVXIKKXLEMLAKMKVTHYXFALDWXSILPTGNLSXVNRQXLRYYRCVVSEGLKLGIXXMVTLYHPTHAHLGLPXPLLXAXGWLNXXTAXAFQXYAXLCFXELGDLVKLWITINEPNRLSDIYNRSXNDTYXAAHNLLIAHAXXWXLYDRQFRPXQXGAVSLSLHXDWAEPANPFXDSHWKAAERFLQFEIAWFADPLFKTGDYPAXMKEYIASKXXRGLSSSXLPRXTXXEXRLLKGTVDFXALNHFTTRFVIHXQLXXXRXXADRDIQFLQDITRLSSPSRLAVXPWGVRKLLXWIRRNYXDXDIYITAXGIDDXALEDDXIRKYYLXKYLQEXLKAYLIDKVKIKGYYAFKLXEEKSKPRFGFFTSDFKAKSSIQFYXKLISSXGXPXENXSXXCXQXXEXTDCTICXFLVXKKPLIFXGCCFXSTLXLLLSIXIFXXQKRRKFXKAKNLQXIPLKKGXXXVXX

SEQ ID NO: 362 - protein, 585 aa, Artificial Sequence
  Description of Artificial Sequence: Synthetic polypeptide
DPSPTLPEQAQPWGAPVEVESFLVHPGDLLQLRCRLRDDVQSINWLRDGVQLAESNRTRITGEEVEVQDSVPADSGLYACVTSSPSGSDTTYFSVNVSDALPSSEDDDDDDDSSSEEKETDNTKPNRMPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERPAVMTSPLYGGGGGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 363 - protein, 1176 aa, Artificial Sequence [sequence omitted]

SEQ ID NO: 364 - protein, 88 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGVPSRFSGSGSGTEFTLTISSLQPEDFATYYC

SEQ ID NO: 365 - protein, 88 aa, Artificial Sequence
  Description of Artificial Sequence: Synthetic polypeptide
DIQMTQSPSSVSASVGDRVTITCRASQGISSWLAWYQQKPGKAPKLLIYAASSLQSGVPSRFSGSGSGTDFTLTISSLQPEDFATYYC

SEQ ID NO: 366 - protein, 93 aa, Artificial Sequence
  Description of Artificial Sequence: Synthetic polypeptide
DIVMTQTPLSLSVTPGQPASISCKSSQSLLHSDGKTYLYWYLQKPGQSPQLLIYEVSSRFSGVPDRFSGSGSGTDFTLKISRVEAEDVGVYYC

SEQ ID NO: 367 - protein, 93 aa, Artificial Sequence
  Description of Artificial Sequence: Synthetic polypeptide
DIVMTQSPLSLPVTPGEPASISCRSSQSLLHSNGYNYLDWYLQKPGQSPQLLIYLGSNRASGVPDRFSGSGSGTDFTLKISRVEAEDVGVYYC

SEQ ID NO: 368 - protein, 93 aa, Artificial Sequence; identical to SEQ ID NO: 367
  Description of Artificial Sequence: Synthetic polypeptide

SEQ ID NO: 369 - protein, 89 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYC

SEQ ID NO: 370 - protein, 88 aa, Artificial Sequence
  Description of Artificial Sequence: Synthetic polypeptide
EIVMTQSPATLSVSPGERATLSCRASQSVSSNLAWYQQKPGQAPRLLIYGASTRATGIPARFSGSGSGTEFTLTISSLQSEDFAVYYC

SEQ ID NO: 371 - protein, 87 aa, Artificial Sequence
  Description of Artificial Sequence: Synthetic polypeptide
SYVLTQPPSVSVAPGKTARITCGGNNIGSKSVHWYQQKPGQAPVLVIYYDSDRPSGIPERFSGSNSGNTATLTISRVEAGDEADYYC

SEQ ID NO: 372 - protein, 98 aa, Artificial Sequence
  Description of Artificial Sequence: Synthetic polypeptide
QVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCAT

SEQ ID NO: 373 - protein, 99 aa, Artificial Sequence
  Description of Artificial Sequence: Synthetic polypeptide
QVTLKESGPVLVKPTETLTLTCTVSGFSLSNARMGVSWIRQPPGKALEWLAHIFSNDEKSYSTSLKSRLTISKDTSKSQVVLTMTNMDPVDTATYYCAR

SEQ ID NO: 374 - protein, 100 aa, Artificial Sequence
  Description of Artificial Sequence: Synthetic polypeptide
EVQLVESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCTT

SEQ ID NO: 375 - protein, 98 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAK

SEQ ID NO: 376 - protein, 98 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCAR

SEQ ID NO: 377 - protein, 99 aa, Artificial Sequence
  Description of Artificial Sequence: Synthetic polypeptide
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCAR

SEQ ID NO: 378 - protein, 97 aa, Artificial Sequence
  Description of Artificial Sequence: Synthetic polypeptide
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCAR

SEQ ID NO: 379 - protein, 5 aa, Artificial Sequence
  Description of Artificial Sequence: Synthetic peptide
GGGGG

SEQ ID NO: 380 - protein, 5 aa, Homo sapiens
CPSCP

SEQ ID NO: 381 - protein, 5 aa, Homo sapiens
CPPCP

SEQ ID NO: 382 - protein, 6 aa, Artificial Sequence
  Description of Artificial Sequence: Synthetic 6xHis tag
HHHHHH

SEQ ID NO: 383 - protein, 5 aa, Artificial Sequence
  Description of Artificial Sequence: Synthetic peptide
HHHHH

SEQ ID NO: 384 - protein, 227 aa, Artificial Sequence
  Description of Artificial Sequence: Synthetic polypeptide
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 385 - protein, 214 aa, Artificial Sequence
  Description of Artificial Sequence: Synthetic polypeptide
SYVLTQPPSVSVAPGKTARITCGGNNIGSESVHWYQQKPGQAPVLVVYDDSDRPSGIPERFSGSNSGNTATLTISRVEAGDEADYYCQVWDGNSDHVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 386 - protein, 214 aa, Artificial Sequence
  Description of Artificial Sequence: Synthetic polypeptide
SYVLTQPPSVSVAPGQTARITCGGNNIGSESVHWYQQKPGQAPVLVVYYDSDRPSGIPERFSGSNSGNTATLTISRVEAGDEADYYCQVWDGNSDHVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 387 - protein, 214 aa, Artificial Sequence
  Description of Artificial Sequence: Synthetic polypeptide
SYVLTQPPSVSVAPGQTARITCGGNNIGSESVHWYQQKPGQAPVLVVYADSDRPSGIPERFSGSNSGNTATLTISRVEAGDEADYYCQVWDGNSDHVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 388 - protein, 214 aa, Artificial Sequence
  Description of Artificial Sequence: Synthetic polypeptide
SYVLTQPPSVSVAPGQTARITCGGNNIGSESVHWYQQKPGQAPVLVVYDDSDRPSGIPERFSGSNSGNTATLTISRVEAGDEADYYCQVWAGNSDHVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 389 - protein, 214 aa, Artificial Sequence
  Description of Artificial Sequence: Synthetic polypeptide
SYVLTQPPSVSVAPGQTARITCGGNNIGSESVHWYQQKPGQAPVLVVYADSDRPSGIPERFSGSNSGNTATLTISRVEAGDEADYYCQVWAGNSDHVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 390 - protein, 450 aa, Artificial Sequence
  Description of Artificial Sequence: Synthetic polypeptide
QVTLKESGPVLVKPTETLTLTCTFSGFSLNNARMGVSWIRQPPGKALEWLAHIFSNDEKSYSTSLKSRLTISKDTSKSQVVLIMTNMDPVDTATYYCARSVVTGGYYYDGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 391 - protein, 450 aa, Artificial Sequence
  Description of Artificial Sequence: Synthetic polypeptide
QVTLKESGPVLVKPTETLTLTCTVSGFSLNNARMGVSWIRQPPGKALEWLAHIFSNDEKSYSTSLKSRLTISKDTSKSQVVLTMTNMDPVDTATYYCARSVVTGGYYYDGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 392 - protein, 450 aa, Artificial Sequence
  Description of Artificial Sequence: Synthetic polypeptide
QVTLKESGPVLVKPTETLTLTCTFSGFSLNNARMGVSWIRQPPGKALEWLAHIFSNDEKSYSTSLKSRLTISKDTSKSQVVLTMTNMDPVDTATYYCARSVVTGGYYYDGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 393 - protein, 450 aa, Artificial Sequence
  Description of Artificial Sequence: Synthetic polypeptide
QVTLKESGPVLVKPTQTLTLTCTFSGFSLNNARMGVSWIRQPPGKALEWLAHIFSNDEKSYSTSLKSRLTISKDTSKSQVVLTMTNMDPVDTATYYCARSVVTGGYYYDGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 394 - protein, 450 aa, Artificial Sequence
  Description of Artificial Sequence: Synthetic polypeptide
QVTLKESGPVLVKPTQTLTLTCTFSGFSLNNARMGVSWIRQPPGKALEWLAHIFSNDEKSYSTSLKSRLTISKDTSKSQVVLTMTNMDPVDTATYYCARSVVTGGYYYDGMDVWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 395 - protein, 450 aa, Artificial Sequence
  Description of Artificial Sequence: Synthetic polypeptide
QVTLKESGPVLVKPTQTLTLTCTFSGFSLNNARMGVSWIRQPPGKALEWLAHIFSNDEKSYSTSLKSRLTISKDTSKSQVVLTMTNMDPVDTATYYCARIVVTGGYYYDGMDVWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 396 - protein, 450 aa, Artificial Sequence
  Description of Artificial Sequence: Synthetic polypeptide
QVTLKESGPVLVKPTETLTLTCTVSGFSLNNARMGVSWIRQPPGKALEWLAHIFSNDEKSYSTSLKSRLTISKDTSKSQVVLKMTNMDPVDTATYYCARSVVTGGYYYDGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 397 - protein, 450 aa, Artificial Sequence
  Description of Artificial Sequence: Synthetic polypeptide
QVTLKESGPVLVKPTETLTLTCTVSGFSLNNARMGVSWIRQPPGKALEWLAHIFSNDEKSYSTSLKSRLTISKDTSKSQVVLIMTNMDPVDTATYYCARIVVTGGYYYDGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 398 - protein, 450 aa, Artificial Sequence
  Description of Artificial Sequence: Synthetic polypeptide
QVTLKESGPVLVKPTETLTLTCTVSGFSLNNARMGVSWIRQPPGKALEWLAHIFSNDEKSYSTSLKSRLTISKDTSKSQVVLIMTNMRAEDTATYYCARSVVTGGYYYDGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 399 - protein, 450 aa, Artificial Sequence
  Description of Artificial Sequence: Synthetic polypeptide
QVTLKESGPVLVKPTETLTLTCTVSGFSLNNARMGVSWIRQPPGKALEWLAHIFSNDEKSYSTSLKSRLTISKDTSKSQVVLIMTNMRAEDTATYYCARIVVTGGYYYDGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 400 - protein, 449 aa, Artificial Sequence
  Description of Artificial Sequence: Synthetic polypeptide
QVTLKESGPVLVKPTETLTLTCTVSGFSLNNARMGVSWIRQPPGKALEWLAHIFSNDEKSYSTSLKSRLTISKDTSKSQVVLIMTNMDPVDTATYYCARSVVTGGYYDGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 401 - protein, 450 aa, Artificial Sequence
  Description of Artificial Sequence: Synthetic polypeptide
QVTLKESGPVLVKPTETLTLTCTVSGFSLNNARMGVSWIRQPPGKALEWLAHIFSNDEKSYSTSLKSRLTISKDTSKSQVVLIMTNMDPVDTATYYCARSVVTGGYYYSGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 402 - protein, 214 aa, Artificial Sequence
  Description of Artificial Sequence: Synthetic polypeptide
SYVLTQPPSVSVAPGQTARITCGGNNIGSQSVHWYQQKPGQAPVLVVYDDSDRPSGIPERFSGSNSGNTATLTISRVEAGDEADYYCQVWDQTSDHVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 403 - protein, 214 aa, Artificial Sequence
  Description of Artificial Sequence: Synthetic polypeptide
SYVLTQPPSVSVAPGQTARITCGGNNIGSQSVHWYQQKPGQAPVLVVYDDSDRPSGIPERFSGSNSGNTATLTISRVEAGDEADYYCQVWDNTADHVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 404 - protein, 450 aa, Artificial Sequence
  Description of Artificial Sequence: Synthetic polypeptide
QVTLKESGPVLVKPTETLTLTCTVSGFSLSNARMGVSWIRQPPGKALEWLAHIFSNDEKSYSTSLKSRLTISKDTSKSQVVLTMTNMDPVDTATYYCARILLVGAYYYSGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 405 - protein, 451 aa, Artificial Sequence
  Description of Artificial Sequence: Synthetic polypeptide
QVTLKESGPVLVKPTETLTLTCTVSGFSLNNARMGVSWIRQPPGKALEWLAHIFSNDEKSYSTSLKSRLTISKDTSKSQVVLIMTNMDPVDTATYYCARSVVTGGYYYYDGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 406 - DNA, 642 bp, Artificial Sequence
  Description of Artificial Sequence: Synthetic polynucleotide
tcctatgtgctgactcagccaccctcggtgtcagtggccccaggaaagacggccaggattacctgtgggggaaacaacattggaagtgaaagtgtgcactggtaccagcagaagccaggccaggcccctgtgctggtcgtctatgatgatagcgaccggccctcagggatccctgagcgattctctggctccaactctgggaacacggccaccctgaccatcagcagggtcgaagccggggatgaggccgactattactgtcaggtgtgggatggtaatagtgaccatgtggtattcggcggagggaccaagctgaccgtcctaggtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccagcagctacctgagcctgacgcccgagcagtggaagtcccacagaagctacagctgccaggtcacgcatgaagggagcaccgtggagaagacagtggcccctacagaatgttca

SEQ ID NO: 407 - DNA, 642 bp, Artificial Sequence
  Description of Artificial Sequence: Synthetic polynucleotide
tcctatgtgctgactcagccaccctcggtgtcagtggccccaggacagacggccaggattacctgtgggggaaacaacattggaagtgaaagtgtgcactggtaccagcagaagccaggccaggcccctgtgctggtcgtctattatgatagcgaccggccctcagggatccctgagcgattctctggctccaactctgggaacacggccaccctgaccatcagcagggtcgaagccggggatgaggccgactattactgtcaggtgtgggatggtaatagtgaccatgtggtattcggcggagggaccaagctgaccgtcctaggtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccagcagctacctgagcctgacgcccgagcagtggaagtcccacagaagctacagctgccaggtcacgcatgaagggagcaccgtggagaagacagtggcccctacagaatgttca

SEQ ID NO: 408 - DNA, 642 bp, Artificial Sequence
  Description of Artificial Sequence: Synthetic polynucleotide
tcctatgtgctgactcagccaccctcggtgtcagtggccccaggacagacggccaggattacctgtgggggaaacaacattggaagtgaaagtgtgcactggtaccagcagaagccaggccaggcccctgtgctggtcgtctatgctgatagcgaccggccctcagggatccctgagcgattctctggctccaactctgggaacacggccaccctgaccatcagcagggtcgaagccggggatgaggccgactattactgtcaggtgtgggatggtaatagtgaccatgtggtattcggcggagggaccaagctgaccgtcctaggtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccagcagctacctgagcctgacgcccgagcagtggaagtcccacagaagctacagctgccaggtcacgcatgaagggagcaccgtggagaagacagtggcccctacagaatgttca

SEQ ID NO: 409 - DNA, 642 bp, Artificial Sequence
  Description of Artificial Sequence: Synthetic polynucleotide
tcctatgtgctgactcagccaccctcggtgtcagtggccccaggacagacggccaggattacctgtgggggaaacaacattggaagtgaaagtgtgcactggtaccagcagaagccaggccaggcccctgtgctggtcgtctatgatgatagcgaccggccctcagggatccctgagcgattctctggctccaactctgggaacacggccaccctgaccatcagcagggtcgaagccggggatgaggccgactattactgtcaggtgtgggctggtaatagtgaccatgtggtattcggcggagggaccaagctgaccgtcctaggtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccagcagctacctgagcctgacgcccgagcagtggaagtcccacagaagctacagctgccaggtcacgcatgaagggagcaccgtggagaagacagtggcccctacagaatgttca

SEQ ID NO: 410 - DNA, 642 bp, Artificial Sequence
  Description of Artificial Sequence: Synthetic polynucleotide
tcctatgtgctgactcagccaccctcggtgtcagtggccccaggacagacggccaggattacctgtgggggaaacaacattggaagtgaaagtgtgcactggtaccagcagaagccaggccaggcccctgtgctggtcgtctatgctgatagcgaccggccctcagggatccctgagcgattctctggctccaactctgggaacacggccaccctgaccatcagcagggtcgaagccggggatgaggccgactattactgtcaggtgtgggctggtaatagtgaccatgtggtattcggcggagggaccaagctgaccgtcctaggtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccagcagctacctgagcctgacgcccgagcagtggaagtcccacagaagctacagctgccaggtcacgcatgaagggagcaccgtggagaagacagtggcccctacagaatgttca

SEQ ID NO: 411 - DNA, 1350 bp, Artificial Sequence
  Description of Artificial Sequence: Synthetic polynucleotide
caggtcaccttgaaggagtctggtcctgtgctggtgaaacccacagagaccctcacgctgacctgcaccttctctgggttctcactcaacaatgctagaatgggtgtgagctggatccgtcagcccccagggaaggccctggagtggcttgcacacattttttcgaatgacgaaaaatcctacagcacatctctgaagagcaggctcaccatctccaaggacacctccaaaagccaggtggtcctaattatgaccaacatggaccctgtggacacagccacatattactgtgcacggtcagtagtaactggcggctactactacgacggtatggacgtctggggccaagggaccacggtcaccgtctctagtgcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 412 - DNA, 1350 bp, Artificial Sequence
  Description of Artificial Sequence: Synthetic polynucleotide
caggtcaccttgaaggagtctggtcctgtgctggtgaaacccacagagaccctcacgctgacctgcaccgtgtctgggttctcactcaacaatgctagaatgggtgtgagctggatccgtcagcccccagggaaggccctggagtggcttgcacacattttttcgaatgacgaaaaatcctacagcacatctctgaagagcaggctcaccatctccaaggacacctccaaaagccaggtggtcctaaccatgaccaacatggaccctgtggacacagccacatattactgtgcacggtcagtagtaactggcggctactactacgacggtatggacgtctggggccaagggaccacggtcaccgtctctagtgcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 413 - DNA, 1350 bp, Artificial Sequence
  Description of Artificial Sequence: Synthetic polynucleotide
caggtcaccttgaaggagtctggtcctgtgctggtgaaacccacagagaccctcacgctgacctgcaccttctctgggttctcactcaacaatgctagaatgggtgtgagctggatccgtcagcccccagggaaggccctggagtggcttgcacacattttttcgaatgacgaaaaatcctacagcacatctctgaagagcaggctcaccatctccaaggacacctccaaaagccaggtggtcctaaccatgaccaacatggaccctgtggacacagccacatattactgtgcacggtcagtagtaactggcggctactactacgacggtatggacgtctggggccaagggaccacggtcaccgtctctagtgcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 414 - DNA, 1350 bp, Artificial Sequence
  Description of Artificial Sequence: Synthetic polynucleotide
caggtcaccttgaaggagtctggtcctgtgctggtgaaacccacacagaccctcacgctgacctgcaccttctctgggttctcactcaacaatgctagaatgggtgtgagctggatccgtcagcccccagggaaggccctggagtggcttgcacacattttttcgaatgacgaaaaatcctacagcacatctctgaagagcaggctcaccatctccaaggacacctccaaaagccaggtggtcctaaccatgaccaacatggaccctgtggacacagccacatattactgtgcacggtcagtagtaactggcggctactactacgacggtatggacgtctggggccaagggaccacggtcaccgtctctagtgcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 415 - DNA, 1350 bp, Artificial Sequence
  Description of Artificial Sequence: Synthetic polynucleotide
caggtcaccttgaaggagtctggtcctgtgctggtgaaacccacacagaccctcacgctgacctgcaccttctctgggttctcactcaacaatgctagaatgggtgtgagctggatccgtcagcccccagggaaggccctggagtggcttgcacacattttttcgaatgacgaaaaatcctacagcacatctctgaagagcaggctcaccatctccaaggacacctccaaaagccaggtggtcctaaccatgaccaacatggaccctgtggacacagccacatattactgtgcacggtcagtagtaactggcggctactactacgacggtatggacgtctggggccaagggaccctggtcaccgtctctagtgcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 416 - DNA, 1350 bp, Artificial Sequence
  Description of Artificial Sequence: Synthetic polynucleotide
caggtcaccttgaaggagtctggtcctgtgctggtgaaacccacacagaccctcacgctgacctgcaccttctctgggttctcactcaacaatgctagaatgggtgtgagctggatccgtcagcccccagggaaggccctggagtggcttgcacacattttttcgaatgacgaaaaatcctacagcacatctctgaagagcaggctcaccatctccaaggacacctccaaaagccaggtggtcctaaccatgaccaacatggaccctgtggacacagccacatattactgtgcacggatcgtagtaactggcggctactactacgacggtatggacgtctggggccaagggaccctggtcaccgtctctagtgcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 417 - DNA, 1350 bp, Artificial Sequence
  Description of Artificial Sequence: Synthetic polynucleotide
caggtcaccttgaaggagtctggtcctgtgctggtgaaacccacagagaccctcacgctgacctgcaccgtgtctgggttctcactcaacaatgctagaatgggtgtgagctggatccgtcagcccccagggaaggccctggagtggcttgcacacattttttcgaatgacgaaaaatcctacagcacatctctgaagagcaggctcaccatctccaaggacacctccaaaagccaggtggtcctaaagatgaccaacatggaccctgtggacacagccacatattactgtgcacggtcagtagtaactggcggctactactacgacggtatggacgtctggggccaagggaccacggtcaccgtctctagtgcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 418 - DNA, 1350 bp, Artificial Sequence
  Description of Artificial Sequence: Synthetic polynucleotide
caggtcaccttgaaggagtctggtcctgtgctggtgaaacccacagagaccctcacgctgacctgcaccgtgtctgggttctcactcaacaatgctagaatgggtgtgagctggatccgtcagcccccagggaaggccctggagtggcttgcacacattttttcgaatgacgaaaaatcctacagcacatctctgaagagcaggctcaccatctccaaggacacctccaaaagccaggtggtcctaattatgaccaacatggaccctgtggacacagccacatattactgtgcacggatcgtagtaactggcggctactactacgacggtatggacgtctggggccaagggaccacggtcaccgtctctagtgcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 419 - DNA, 1350 bp, Artificial Sequence
  Description of Artificial Sequence: Synthetic polynucleotide
caggtcaccttgaaggagtctggtcctgtgctggtgaaacccacagagaccctcacgctgacctgcaccgtgtctgggttctcactcaacaatgctagaatgggtgtgagctggatccgtcagcccccagggaaggccctggagtggcttgcacacattttttcgaatgacgaaaaatcctacagcacatctctgaagagcaggctcaccatctccaaggacacctccaaaagccaggtggtcctaattatgaccaacatgagagctgaggacacagccacatattactgtgcacggtcagtagtaactggcggctactactacgacggtatggacgtctggggccaagggaccacggtcaccgtctctagtgcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 420 - DNA, 1350 bp, Artificial Sequence
  Description of Artificial Sequence: Synthetic polynucleotide
caggtcaccttgaaggagtctggtcctgtgctggtgaaacccacagagaccctcacgctgacctgcaccgtgtctgggttctcactcaacaatgctagaatgggtgtgagctggatccgtcagcccccagggaaggccctggagtggcttgcacacattttttcgaatgacgaaaaatcctacagcacatctctgaagagcaggctcaccatctccaaggacacctccaaaagccaggtggtcctaattatgaccaacatgagagctgaggacacagccacatattactgtgcacggatcgtagtaactggcggctactactacgacggtatggacgtctggggccaagggaccacggtcaccgtctctagtgcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 421 - DNA, 1347 bp, Artificial Sequence
  Description of Artificial Sequence: Synthetic polynucleotide
caggtcaccttgaaggagtctggtcctgtgctggtgaaacccacagagaccctcacgctgacctgcaccgtgtctgggttctcactcaacaatgctagaatgggtgtgagctggatccgtcagcccccagggaaggccctggagtggcttgcacacattttttcgaatgacgaaaaatcctacagcacatctctgaagagcaggctcaccatctccaaggacacctccaaaagccaggtggtcctaattatgaccaacatggaccctgtggacacagccacatattactgtgcacggtcagtagtaactggcggctactacgacggtatggacgtctggggccaagggaccacggtcaccgtctctagtgcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 422 - DNA, 1350 bp, Artificial Sequence
  Description of Artificial Sequence: Synthetic polynucleotide
caggtcaccttgaaggagtctggtcctgtgctggtgaaacccacagagaccctcacgctgacctgcaccgtgtctgggttctcactcaacaatgctagaatgggtgtgagctggatccgtcagcccccagggaaggccctggagtggcttgcacacattttttcgaatgacgaaaaatcctacagcacatctctgaagagcaggctcaccatctccaaggacacctccaaaagccaggtggtcctaattatgaccaacatggaccctgtggacacagccacatattactgtgcacggtcagtagtaactggcggctactactacagcggtatggacgtctggggccaagggaccacggtcaccgtctctagtgcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 423 - DNA, 642 bp, Artificial Sequence
  Description of Artificial Sequence: Synthetic polynucleotide
tcctatgtgctgactcagccaccctcggtgtcagtggccccaggacagacggccaggattacctgtgggggaaacaacattggaagtcaaagtgtgcactggtaccagcagaagccaggccaggcccctgtcctggtcgtctatgatgatagcgaccggccctcagggatccctgagcgattctctggttccaactctgggaacacggccaccctgaccatcagcagggtcgaagccggggatgaggccgactattactgtcaggtgtgggatcagactagtgatcatgtggtattcggcggggggaccaagctgaccgtcctaggtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccagcagctacctgagcctgacgcccgagcagtggaagtcccacagaagctacagctgccaggtcacgcatgaagggagcaccgtggagaagacagtggcccctacagaatgttca

SEQ ID NO: 424 - DNA, 642 bp, Artificial Sequence
  Description of Artificial Sequence: Synthetic polynucleotide
tcctatgtgctgactcagccaccctcggtgtcagtggccccaggacagacggccaggattacctgtgggggaaacaacattggaagtcaaagtgtgcactggtaccagcagaagccaggccaggcccctgtcctggtcgtctatgatgatagcgaccggccctcagggatccctgagcgattctctggttccaactctgggaacacggccaccctgaccatcagcagggtcgaagccggggatgaggccgactattactgtcaggtgtgggataatactgctgatcatgtggtattcggcggggggaccaagctgaccgtcctaggtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccagcagctacctgagcctgacgcccgagcagtggaagtcccacagaagctacagctgccaggtcacgcatgaagggagcaccgtggagaagacagtggcccctacagaatgttca

SEQ ID NO: 425 - DNA, 1350 bp, Artificial Sequence
  Description of Artificial Sequence: Synthetic polynucleotide
caggtcaccttgaaggagtctggtcctgtgctggtgaaacccacagagaccctcacgctgacctgcaccgtgtctgggttctcactcagcaatgctagaatgggtgtgagctggatccgtcagcccccagggaaggccctggagtggcttgcacacattttttcgaatgacgaaaaatcctacagcacatctctgaagagcaggctcaccatctccaaggacacctccaaaagccaggtggtccttaccatgaccaacatggaccctgtggacacagccacatattactgtgcacggatattattagtgggagcttactactacagcggtatggacgtctggggccaagggaccacggtcaccgtctctagtgcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 426 - DNA, 1353 bp, Artificial Sequence
  Description of Artificial Sequence: Synthetic polynucleotide
caggtcaccttgaaggagtctggtcctgtgctggtgaaacccacagagaccctcacgctgacctgcaccgtgtctgggttctcactcaacaatgctagaatgggtgtgagctggatccgtcagcccccagggaaggccctggagtggcttgcacacattttttcgaatgacgaaaaatcctacagcacatctctgaagagcaggctcaccatctccaaggacacctccaaaagccaggtggtcctaattatgaccaacatggaccctgtggacacagccacatattactgtgcacggtcagtagtaactggcggctactattactacgacggtatggacgtctggggccaagggaccacggtcaccgtctctagtgcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 427 - protein, 7 aa, Artificial Sequence
  Description of Artificial Sequence: Synthetic peptide
YDSDRPS

SEQ ID NO: 428 - protein, 7 aa, Artificial Sequence
  Description of Artificial Sequence: Synthetic peptide
ADSDRPS

SEQ ID NO: 429 - protein, 11 aa, Artificial Sequence
  Description of Artificial Sequence: Synthetic peptide
QVWAGNSDHVV

SEQ ID NO: 430 - protein, 11 aa, Artificial Sequence
  Description of Artificial Sequence: Synthetic peptide
QVWAGNSDHVV

SEQ ID NO: 431 - protein, 14 aa, Artificial Sequence
  Description of Artificial Sequence: Synthetic peptide
IVVTGGYYYDGMDV

SEQ ID NO: 432 - protein, 14 aa, Artificial Sequence
  Description of Artificial Sequence: Synthetic peptide
IVVTGGYYYDGMDV

SEQ ID NO: 433 - protein, 14 aa, Artificial Sequence
  Description of Artificial Sequence: Synthetic peptide
IVVTGGYYYDGMDV

SEQ ID NO: 434 - protein, 13 aa, Artificial Sequence
  Description of Artificial Sequence: Synthetic peptide
SVVTGGYYDGMDV

SEQ ID NO: 435 - protein, 14 aa, Artificial Sequence
  Description of Artificial Sequence: Synthetic peptide
SVVTGGYYYSGMDV

SEQ ID NO: 436 - protein, 11 aa, Artificial Sequence
  Description of Artificial Sequence: Synthetic peptide
QVWDQTSDHVV

SEQ ID NO: 437 - protein, 11 aa, Artificial Sequence
  Description of Artificial Sequence: Synthetic peptide
QVWDNTADHVV

SEQ ID NO: 438 - protein, 14 aa, Artificial Sequence
  Description of Artificial Sequence: Synthetic peptide
ILLVGAYYYSGMDV

SEQ ID NO: 439 - protein, 15 aa, Artificial Sequence
  Description of Artificial Sequence: Synthetic peptide
SVVTGGYYYYDGMDV

SEQ ID NO: 440 - protein, 40 aa, Artificial Sequence
  Description of Artificial Sequence: Synthetic polypeptide
GGGGSGGGGSGGGGSGGGGSGGGGSGGGGSGGGGSGGGGS

SEQ ID NO: 441 - protein, 228 aa, Artificial Sequence
  Description of Artificial Sequence: Synthetic polypeptide
ERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 442 - DNA, 21 bp, Artificial Sequence
  Description of Artificial Sequence: Synthetic oligonucleotide
tatgatagcgaccggccctca

SEQ ID NO: 443 - DNA, 21 bp, Artificial Sequence
  Description of Artificial Sequence: Synthetic oligonucleotide
gctgatagcgaccggccctca

SEQ ID NO: 444 - DNA, 21 bp, Artificial Sequence
  Description of Artificial Sequence: Synthetic oligonucleotide
gctgatagcgaccggccctca

SEQ ID NO: 445 - DNA, 33 bp, Artificial Sequence
  Description of Artificial Sequence: Synthetic oligonucleotide
caggtgtgggctggtaatagtgaccatgtggta

SEQ ID NO: 446 - DNA, 42 bp, Artificial Sequence
  Description of Artificial Sequence: Synthetic oligonucleotide
atcgtagtaactggcggctactactacgacggtatggacgtc

SEQ ID NO: 447 - DNA, 39 bp, Artificial Sequence
  Description of Artificial Sequence: Synthetic oligonucleotide
tcagtagtaactggcggctactacgacggtatggacgtc

SEQ ID NO: 448 - DNA, 42 bp, Artificial Sequence
  Description of Artificial Sequence: Synthetic oligonucleotide
tcagtagtaactggcggctactactacagcggtatggacgtc

SEQ ID NO: 449 - DNA, 33 bp, Artificial Sequence
  Description of Artificial Sequence: Synthetic oligonucleotide
caggtgtgggatcagactagtgatcatgtggta

SEQ ID NO: 450 - DNA, 33 bp, Artificial Sequence
  Description of Artificial Sequence: Synthetic oligonucleotide
caggtgtgggataatactgctgatcatgtggta

SEQ ID NO: 451 - DNA, 42 bp, Artificial Sequence
  Description of Artificial Sequence: Synthetic oligonucleotide
atattattagtgggagcttactactacagcggtatggacgtc

SEQ ID NO: 452 - DNA, 45 bp, Artificial Sequence
  Description of Artificial Sequence: Synthetic oligonucleotide
tcagtagtaactggcggctactattactacgacggtatggacgtc

SEQ ID NO: 453 - protein, 739 aa, Artificial Sequence [sequence omitted]

SEQ ID NO: 454 - DNA, 2217 bp, Artificial Sequence
  Description of Artificial Sequence: Synthetic polynucleotide
atggacatgagggtgcccgctcagctcctggggctcctgctgctgtggctgagaggtgcgcgctgtcaggtcaccttgaaggagtctggtcctgtgctggtgaaacccacagagaccctcacgctgacctgcaccgtgtctgggttctcactcaacaatgctagaatgggtgtgagctggatccgtcagcccccagggaaggccctggagtggcttgcacacattttttcgaatgacgaaaaatcctacagcacatctctgaagagcaggctcaccatctccaaggacacctccaaaagccaggtggtcctaattatgaccaacatggaccctgtggacacagccacatattactgtgcacggtcagtagtaactggcggctactactacgacggtatggacgtctggggccaagggaccacggtcaccgtctctagtgccagcaccaagggcccctccgtgttccctctggccccctgcagcagaagcaccagcgagagcacagccgccctgggctgcctggtcaaggactacttccccgagcccgtgaccgtgtcttggaacagcggagccctgaccagcggcgtgcacacctttccagccgtgctgcagagcagcggcctgtacagcctgagcagcgtggtcaccgtgcccagcagcaacttcggcacccagacctacacctgtaacgtggaccacaagcccagcaacaccaaggtggacaagacagtggagcggaagtccagcgtggagtgccctccttgtcctgcccctcctgtggccggacctagcgtgttcctgttccccccaaagcccaaggacaccctgatgatcagccggacccccgaagtgacctgcgtggtggtggacgtgtcccacgaggaccccgaggtgcagttcaattggtacgtggacggggtggaggtgcacaacgccaagaccaagccccgggaggaacagttcaacagcaccttccgggtggtgtccgtcctcaccgtggtgcaccaggactggctgaacggcaaagagtacaagtgcaaggtctccaacaagggcctgcctgcccccatcgagaaaaccatcagcaagaccaagggccagcctcgggagcctcaggtgtacaccctgccccccagccgggaggaaatgaccaagaaccaggtgtccctgacctgcctcgtgaagggcttctaccccagcgatatcgccgtggagtgggagagcaacggccagcccgagaacaactacaagaccaccccccccatgctggacagcgacggcagcttcttcctgtactccaaactgaccgtggacaagagccggtggcagcagggcaacgtgttcagctgtagcgtgatgcacgaggccctgcacaaccactacacccagaagtccctgagcctgtctcctggcggaggcggaggatctggcggcggaggaagtggagggggcggatctggtggtggaggcagcggcggaggtggaagtggcggtggaggatccggtggaggcggctcaggtggcggcggaagcgagagaaagtcctccgtggagtgtccaccatgccctgctccaccagtggctggcccttccgtctttctctttccacctaaacctaaggatacactcatgatctccagaactccagaggtcacatgtgtggtcgtcgatgtcagtcatgaggatcctgaagtccagtttaactggtatgtggatggcgtcgaagtccataatgctaagacaaaacctcgcgaagaacagtttaactccacctttagagtcgtgagcgtgctgacagtcgtccatcaggattggctcaatgggaaagaatacaaatgtaaagtctctaacaaaggactgcccgctcctatcgaaaagaccatctccaaaacaaaggggcagcccagagagccccaggtctacacactcccaccctccagagaagagatgacaaaaaatcaggtgtcactcacctgtctggtcaaggggttttacccctccgacattgccgtggaatgggaatccaatgggcagcctgaaaacaattataagactacacctcctatgctcgactctgatgggagtttctttctctactctaaactcacagtggataagtctagatggcagcaggggaatgtcttttcctgctccgtcatgcatgaagctctccacaatcattatacacagaagtctttgtccctgtcccccggcaag

SEQ ID NO: 455 - protein, 1042 aa, Artificial Sequence
  Description of Artificial Sequence: Synthetic polypeptide
MKPGCAAGSPGNEWIFFSTDEITTRYRNTMSNGGLQRSVILSALILLRAVTGFSGDGRAIWSKNPNFTPVNESQLFLYDTFPKNFSWGVGTGAFQVEGSWKTDGRGPSIWDRYVYSHLRGVNGTDRSTDSYIFLEKDLLALDFLGVSFYQFSISWPRLFPNGTVAAVNAQGLRYYRALLDSLVLRNIEPIVTLYHWDLPLTLQEEYGGWKNATMIDLFNDYATYCFQTFGDRVKYWITIHNPYLVAWHGFGTGMHAPGEKGNLTAVYTVGHNLIKAHSKVWHNYDKNFRPHQKGWLSITLGSHWIEPNRTDNMEDVINCQHSMSSVLGWFANPIHGDGDYPEFMKTGAMIPEFSEAEKEEVRGTADFFAFSFGPNNFRPSNTVVKMGQNVSLNLRQVLNWIKLEYDDPQILISENGWFTDSYIKTEDTTAIYMMKNFLNQVLQAIKFDEIRVFGYTAWTLLDGFEWQDAYTTRRGLFYVDFNSEQKERKPKSSAHYYKQIIQDNGFPLKESTPDMKGRFPCDFSWGVTESVLKPESVASSPQFSDPHLYVWNATGNRLLHRVEGVRLKTRPAQCTDFVNIKKQLEMLARMKVTHYRFALDWASVLPTGNLSAVNRQALRYYRCVVSEGLKLGISAMVTLYYPTHAHLGLPEPLLHADGWLNPSTAEAFQAYAGLCFQELGDLVKLWITINEPNRLSDIYNRSGNDTYGAAHNLLVAHALAWRLYDQQFRPSQRGAVSLSLHADWAEPANPYADSHWRAAERFLQFEIAWFAEPLFKTGDYPAAMREYIASKHRRGLSSSALPRLTEAERRLLKGTVDFCALNHFTTRFVMHEQLAGSRYDSDRDIQFLQDITRLSSPTRLAVIPWGVRKLLRWVRRNYGDMDIYITASGIDDQALEDDRLRKYYLGKYLQEVLKAYLIDKVRIKGYYAFKLAEEKSKPRFGFFTSDFKAKSSIQFYNKVISSRGFPFENSSSRCSQTQENTECTVCLFLVQKKPLIFLGCCFFSTLVLLLSIAIFQRQKRRKFWKAKNLQHIPLKKGKRVVS

SEQ ID NO: 456 - protein, 1045 aa, Artificial Sequence
  Description of Artificial Sequence: Synthetic polypeptide
MKPGCAAGSPGNEWIFFSTDEITTRYRNTMSNGGLQRSVILSALILLRAVTGFSGDGRAIWSKNPNFTPVNESQLFLYDTFPKNFFWGIGTGALQVEGSWKKDGKGPSIWDHFIHTHLKNVSSTNGSSDSYIFLEKDLSALDFIGVSFYQFSISWPRLFPDGIVTVANAKGLQYYSTLLDALVLRNIEPIVTLYHWDLPLALQEKYGGWKNDTIIDIFNDYATYCFQMFGDRVKYWITIHNPYLVAWHGYGTGMHAPGEKGNLAAVYTVGHNLIKAHSKVWHNYNTHFRPHQKGWLSITLGSHWIEPNRSENTMDIFKCQQSMVSVLGWFANPIHGDGDYPEGMRKKLFSVLPIFSEAEKHEMRGTADFFAFSFGPNNFKPLNTMAKMGQNVSLNLREALNWIKLEYNNPRILIAENGWFTDSRVKTEDTTAIYMMKNFLSQVLQAIRLDEIRVFGYTAWSLLDGFEWQDAYTIRRGLFYVDFNSKQKERKPKSSAHYYKQIIRENGFPLKESTPDMKGRFPCDFSWGVTESVLKPEFTVSSPQFTDPHLYVWNVTGNRLLYRVEGVRLKTRPSQCTDYVSIKKRVEMLAKMKVTHYQFALDWTSILPTGNLSKVNRQVLRYYRCVVSEGLKLGVFPMVTLYHPTHSHLGLPLPLLSSGGWLNMNTAKAFQDYAELCFRELGDLVKLWITINEPNRLSDMYNRTSNDTYRAAHNLMIAHAQVWHLYDRQYRPVQHGAVSLSLHCDWAEPANPFVDSHWKAAERFLQFEIAWFADPLFKTGDYPSVMKEYIASKNQRGLSSSVLPRFTAKESRLVKGTVDFYALNHFTTRFVIHKQLNTNRSVADRDVQFLQDITRLSSPSRLAVTPWGVRKLLAWIRRNYRDRDIYITANGIDDLALEDDQIRKYYLEKYVQEALKAYLIDKVKIKGYYAFKLTEEKSKPRFGFFTSDFRAKSSVQFYSKLISSSGLPAENRSPACGQPAEDTDCTICSFLVEKKPLIFFGCCFISTLAVLLSITVFHHQKRRKFQKARNLQNIPLKKGHSRVFS

SEQ ID NO: 457 - protein, 1044 aa, Artificial Sequence
  Description of Artificial Sequence: Synthetic polypeptide
MKTGCAAGSPGNEWIFFSSDERNTRSRKTMSNRALQRSAVLSAFVLLRAVTGFSGDGKAIWDKKQYVSPVNPSQLFLYDTFPKNFSWGVGTGAFQVEGSWKTDGRGPSIWDRYVYSHLRGVNGTDRSTDSYIFLEKDLLALDFLGVSFYQFSISWPRLFPNGTVAAVNAQGLRYYRALLDSLVLRNIEPIVTLYHWDLPLALQEKYGGWKNDTIIDIFNDYATYCFQMFGDRVKYWITIHNPYLVAWHGYGTGMHAPGEKGNLAAVYTVGHNLIKAHSKVWHNYNTHFRPHQKGWLSITLGSHWIEPNRSENTMDIFKCQQSMVSVLGWFANPIHGDGDYPEGMRKKLFSVLPIFSEAEKHEMRGTADFFAFSFGPNNFKPLNTMAKMGQNVSLNLREALNWIKLEYNNPRILIAENGWFTDSRVKTEDTTAIYMMKNFLSQVLQAIRLDEIRVFGYTAWSLLDGFEWQDAYTIRRGLFYVDFNSKQKERKPKSSAHYYKQIIRENGFSLKESTPDVQGQFPCDFSWGVTESVLKPESVASSPQFSDPHLYVWNATGNRLLHRVEGVRLKTRPAQCTDFVNIKKQLEMLARMKVTHYRFALDWASVLPTGNLSAVNRQALRYYRCVVSEGLKLGISAMVTLYYPTHAHLGLPEPLLHADGWLNPSTAEAFQAYAGLCFQELGDLVKLWITINEPNRLSDIYNRSGNDTYGAAHNLLVAHALAWRLYDQQFRPSQRGAVSLSLHADWAEPANPYADSHWRAAERFLQFEIAWFAEPLFKTGDYPAAMREYIASKHRRGLSSSALPRLTEAERRLLKGTVDFCALNHFTTRFVMHEQLAGSRYDSDRDIQFLQDITRLSSPTRLAVIPWGVRKLLRWVRRNYGDMDIYITASGIDDQALEDDRLRKYYLGKYLQEVLKAYLIDKVRIKGYYAFKLAEEKSKPRFGFFTSDFKAKSSIQFYNKVISSRGFPFENSSSRCSQTQENTECTVCLFLVQKKPLIFLGCCFFSTLVLLLSIAIFQRQKRRKFWKAKNLQHIPLKKGKRVVS

SEQ ID NO: 458 - protein, 1044 aa, Artificial Sequence
  Description of Artificial Sequence: Synthetic polypeptide
MKPGCAAGSPGNEWIFFSTDEITTRYRNTMSNGGLQRSVILSALILLRAVTGFSGDGRAIWSKNPNFTPVNESQLFLYDTFPKNFSWGVGTGAFQVEGSWKTDGRGPSIWDRYVYSHLRGVNGTDRSTDSYIFLEKDLLALDFLGVSFYQFSISWPRLFPNGTVAAVNAQGLRYYRALLDSLVLRNIEPIVTLYHWDLPLTLQEEYGGWKNATMIDLFNDYATYCFQTFGDRVKYWITIHNPYLVAWHGFGTGMHAPGEKGNLTAVYTVGHNLIKAHSKVWHNYDKNFRPHQKGWLSITLGSHWIEPNRSENTMDIFKCQQSMVSVLGWFANPIHGDGDYPEGMRKKLFSVLPIFSEAEKHEMRGTADFFAFSFGPNNFKPLNTMAKMGQNVSLNLREALNWIKLEYNNPRILIAENGWFTDSRVKTEDTTAIYMMKNFLSQVLQAIRLDEIRVFGYTAWSLLDGFEWQDAYTIRRGLFYVDFNSKQKERKPKSSAHYYKQIIRENGFSLKESTPDVQGQFPCDFSWGVTESVLKPESVASSPQFSDPHLYVWNATGNRLLHRVEGVRLKTRPAQCTDFVNIKKQLEMLARMKVTHYRFALDWASVLPTGNLSAVNRQALRYYRCVVSEGLKLGISAMVTLYYPTHAHLGLPEPLLHADGWLNPSTAEAFQAYAGLCFQELGDLVKLWITINEPNRLSDIYNRSGNDTYGAAHNLLVAHALAWRLYDQQFRPSQRGAVSLSLHADWAEPANPYADSHWRAAERFLQFEIAWFAEPLFKTGDYPAAMREYIASKHRRGLSSSALPRLTEAERRLLKGTVDFCALNHFTTRFVMHEQLAGSRYDSDRDIQFLQDITRLSSPTRLAVIPWGVRKLLRWVRRNYGDMDIYITASGIDDQALEDDRLRKYYLGKYLQEVLKAYLIDKVRIKGYYAFKLAEEKSKPRFGFFTSDFKAKSSIQFYNKVISSRGFPFENSSSRCSQTQENTECTVCLFLVQKKPLIFLGCCFFSTLVLLLSIAIFQRQKRRKFWKAKNLQHIPLKKGKRVVS

SEQ ID NO: 459 - protein, 1042 aa, Artificial Sequence
  Description of Artificial Sequence: Synthetic polypeptide
MKPGCAAGSPGNEWIFFSTDEITTRYRNTMSNGGLQRSVILSALILLRAVTGFSGDGRAIWSKNPNFTPVNESQLFLYDTFPKNFFWGIGTGALQVEGSWKKDGKGPSIWDHFIHTHLKNVSSTNGSSDSYIFLEKDLSALDFIGVSFYQFSISWPRLFPDGIVTVANAKGLQYYSTLLDALVLRNIEPIVTLYHWDLPLTLQEEYGGWKNATMIDLFNDYATYCFQTFGDRVKYWITIHNPYLVAWHGFGTGMHAPGEKGNLTAVYTVGHNLIKAHSKVWHNYDKNFRPHQKGWLSITLGSHWIEPNRTDNMEDVINCQHSMSSVLGWFANPIHGDGDYPEFMKTGAMIPEFSEAEKEEVRGTADFFAFSFGPNNFRPSNTVVKMGQNVSLNLRQVLNWIKLEYDDPQILISENGWFTDSRVKTEDTTAIYMMKNFLSQVLQAIRLDEIRVFGYTAWSLLDGFEWQDAYTIRRGLFYVDFNSKQKERKPKSSAHYYKQIIRENGFSLKESTPDVQGQFPCDFSWGVTESVLKPESVASSPQFSDPHLYVWNATGNRLLHRVEGVRLKTRPAQCTDFVNIKKQLEMLARMKVTHYRFALDWASVLPTGNLSAVNRQALRYYRCVVSEGLKLGISAMVTLYYPTHAHLGLPEPLLHADGWLNPSTAEAFQAYAGLCFQELGDLVKLWITINEPNRLSDIYNRSGNDTYGAAHNLLVAHALAWRLYDQQFRPSQRGAVSLSLHADWAEPANPYADSHWRAAERFLQFEIAWFAEPLFKTGDYPAAMREYIASKHRRGLSSSALPRLTEAERRLLKGTVDFCALNHFTTRFVMHEQLAGSRYDSDRDIQFLQDITRLSSPTRLAVIPWGVRKLLRWVRRNYGDMDIYITASGIDDQALEDDRLRKYYLGKYLQEVLKAYLIDKVRIKGYYAFKLAEEKSKPRFGFFTSDFKAKSSIQFYNKVISSRGFPFENSSSRCSQTQENTECTVCLFLVQKKPLIFLGCCFFSTLVLLLSIAIFQRQKRRKFWKAKNLQHIPLKKGKRVVS

SEQ ID NO: 460 - protein, 1042 aa, Artificial Sequence
  Description of Artificial Sequence: Synthetic polypeptide
MKPGCAAGSPGNEWIFFSTDEITTRYRNTMSNGGLQRSVILSALILLRAVTGFSGDGRAIWSKNPNFTPVNESQLFLYDTFPKNFFWGIGTGALQVEGSWKKDGKGPSIWDHFIHTHLKNVSSTNGSSDSYIFLEKDLSALDFIGVSFYQFSISWPRLFPDGIVTVANAKGLQYYSTLLDALVLRNIEPIVTLYHWDLPLALQEKYGGWKNDTIIDIFNDYATYCFQMFGDRVKYWITIHNPYLVAWHGYGTGMHAPGEKGNLAAVYTVGHNLIKAHSKVWHNYNTHFRPHQKGWLSITLGSHWIEPNRTDNMEDVINCQHSMSSVLGWFANPIHGDGDYPEFMKTGAMIPEFSEAEKEEVRGTADFFAFSFGPNNFRPSNTVVKMGQNVSLNLRQVLNWIKLEYDDPQILISENGWFTDSYIKTEDTTAIYMMKNFLNQVLQAIKFDEIRVFGYTAWTLLDGFEWQDAYTTRRGLFYVDFNSEQKERKPKSSAHYYKQIIQDNGFSLKESTPDVQGQFPCDFSWGVTESVLKPESVASSPQFSDPHLYVWNATGNRLLHRVEGVRLKTRPAQCTDFVNIKKQLEMLARMKVTHYRFALDWASVLPTGNLSAVNRQALRYYRCVVSEGLKLGISAMVTLYYPTHAHLGLPEPLLHADGWLNPSTAEAFQAYAGLCFQELGDLVKLWITINEPNRLSDIYNRSGNDTYGAAHNLLVAHALAWRLYDQQFRPSQRGAVSLSLHADWAEPANPYADSHWRAAERFLQFEIAWFAEPLFKTGDYPAAMREYIASKHRRGLSSSALPRLTEAERRLLKGTVDFCALNHFTTRFVMHEQLAGSRYDSDRDIQFLQDITRLSSPTRLAVIPWGVRKLLRWVRRNYGDMDIYITASGIDDQALEDDRLRKYYLGKYLQEVLKAYLIDKVRIKGYYAFKLAEEKSKPRFGFFTSDFKAKSSIQFYNKVISSRGFPFENSSSRCSQTQENTECTVCLFLVQKKPLIFLGCCFFSTLVLLLSIAIFQRQKRRKFWKAKNLQHIPLKKGKRVVS

SEQ ID NO: 461 - protein, 1044 aa, Artificial Sequence
  Description of Artificial Sequence: Synthetic polypeptide
MKPGCAAGSPGNEWIFFSTDEITTRYRNTMSNGGLQRSVILSALILLRAVTGFSGDGRAIWSKNPNFTPVNESQLFLYDTFPKNFFWGIGTGALQVEGSWKKDGKGPSIWDHFIHTHLKNVSSTNGSSDSYIFLEKDLSALDFIGVSFYQFSISWPRLFPDGIVTVANAKGLQYYSTLLDALVLRNIEPIVTLYHWDLPLALQEKYGGWKNDTIIDIFNDYATYCFQMFGDRVKYWITIHNPYLVAWHGYGTGMHAPGEKGNLAAVYTVGHNLIKAHSKVWHNYNTHFRPHQKGWLSITLGSHWIEPNRSENTMDIFKCQQSMVSVLGWFANPIHGDGDYPEGMRKKLFSVLPIFSEAEKHEMRGTADFFAFSFGPNNFKPLNTMAKMGQNVSLNLREALNWIKLEYNNPRILIAENGWFTDSYIKTEDTTAIYMMKNFLNQVLQAIKFDEIRVFGYTAWTLLDGFEWQDAYTTRRGLFYVDFNSEQKERKPKSSAHYYKQIIQDNGFPLKESTPDMKGRFPCDFSWGVTESVLKPESVASSPQFSDPHLYVWNATGNRLLHRVEGVRLKTRPAQCTDFVNIKKQLEMLARMKVTHYRFALDWASVLPTGNLSAVNRQALRYYRCVVSEGLKLGISAMVTLYYPTHAHLGLPEPLLHADGWLNPSTAEAFQAYAGLCFQELGDLVKLWITINEPNRLSDIYNRSGNDTYGAAHNLLVAHALAWRLYDQQFRPSQRGAVSLSLHADWAEPANPYADSHWRAAERFLQFEIAWFAEPLFKTGDYPAAMREYIASKHRRGLSSSALPRLTEAERRLLKGTVDFCALNHFTTRFVMHEQLAGSRYDSDRDIQFLQDITRLSSPTRLAVIPWGVRKLLRWVRRNYGDMDIYITASGIDDQALEDDRLRKYYLGKYLQEVLKAYLIDKVRIKGYYAFKLAEEKSKPRFGFFTSDFKAKSSIQFYNKVISSRGFPFENSSSRCSQTQENTECTVCLFLVQKKPLIFLGCCFFSTLVLLLSIAIFQRQKRRKFWKAKNLQHIPLKKGKRVVS

SEQ ID NO: 462 - protein, 1044 aa, Artificial Sequence
  Description of Artificial Sequence: Synthetic polypeptide
MKPGCAAGSPGNEWIFFSTDEITTRYRNTMSNGGLQRSVILSALILLRAVTGFSGDGRAIWSKNPNFTPVNESQLFLYDTFPKNFFWGIGTGALQVEGSWKKDGKGPSIWDHFIHTHLKNVSSTNGSSDSYIFLEKDLSALDFIGVSFYQFSISWPRLFPDGIVTVANAKGLQYYSTLLDALVLRNIEPIVTLYHWDLPLALQEKYGGWKNDTIIDIFNDYATYCFQMFGDRVKYWITIHNPYLVAWHGYGTGMHAPGEKGNLAAVYTVGHNLIKAHSKVWHNYNTHFRPHQKGWLSITLGSHWIEPNRSENTMDIFKCQQSMVSVLGWFANPIHGDGDYPEGMRKKLFSVLPIFSEAEKHEMRGTADFFAFSFGPNNFKPLNTMAKMGQNVSLNLREALNWIKLEYNNPRILIAENGWFTDSRVKTEDTTAIYMMKNFLSQVLQAIRLDEIRVFGYTAWSLLDGFEWQDAYTIRRGLFYVDFNSKQKERKPKSSAHYYKQIIRENGFPLKESTPDMKGRFPCDFSWGVTESVLKPEFTVSSPQFTDPHLYVWNVTGNRLLYRVEGVRLKTRPSQCTDYVSIKKRVEMLAKMKVTHYQFALDWTSILPTGNLSKVNRQVLRYYRCVVSEGLKLGISAMVTLYYPTHAHLGLPEPLLHADGWLNPSTAEAFQAYAGLCFQELGDLVKLWITINEPNRLSDIYNRSGNDTYGAAHNLLVAHALAWRLYDQQFRPSQRGAVSLSLHADWAEPANPYADSHWRAAERFLQFEIAWFAEPLFKTGDYPAAMREYIASKHRRGLSSSALPRLTEAERRLLKGTVDFCALNHFTTRFVMHEQLAGSRYDSDRDIQFLQDITRLSSPTRLAVIPWGVRKLLRWVRRNYGDMDIYITASGIDDQALEDDRLRKYYLGKYLQEVLKAYLIDKVRIKGYYAFKLAEEKSKPRFGFFTSDFKAKSSIQFYNKVISSRGFPFENSSSRCSQTQENTECTVCLFLVQKKPLIFLGCCFFSTLVLLLSIAIFQRQKRRKFWKAKNLQHIPLKKGKRVVS

SEQ ID NO: 463 - protein, 1044 aa, Artificial Sequence
  Description of Artificial Sequence: Synthetic polypeptide
MKPGCAAGSPGNEWIFFSTDEITTRYRNTMSNGGLQRSVILSALILLRAVTGFSGDGRAIWSKNPNFTPVNESQLFLYDTFPKNFFWGIGTGALQVEGSWKKDGKGPSIWDHFIHTHLKNVSSTNGSSDSYIFLEKDLSALDFIGVSFYQFSISWPRLFPDGIVTVANAKGLQYYSTLLDALVLRNIEPIVTLYHWDLPLALQEKYGGWKNDTIIDIFNDYATYCFQMFGDRVKYWITIHNPYLVAWHGYGTGMHAPGEKGNLAAVYTVGHNLIKAHSKVWHNYNTHFRPHQKGWLSITLGSHWIEPNRSENTMDIFKCQQSMVSVLGWFANPIHGDGDYPEGMRKKLFSVLPIFSEAEKHEMRGTADFFAFSFGPNNFKPLNTMAKMGQNVSLNLREALNWIKLEYNNPRILIAENGWFTDSRVKTEDTTAIYMMKNFLSQVLQAIRLDEIRVFGYTAWSLLDGFEWQDAYTIRRGLFYVDFNSKQKERKPKSSAHYYKQIIRENGFSLKESTPDVQGQFPCDFSWGVTESVLKPEFTVSSPQFTDPHLYVWNVTGNRLLYRVEGVRLKTRPSQCTDYVSIKKRVEMLAKMKVTHYQFALDWTSILPTGNLSKVNRQVLRYYRCVVSEGLKLGVFPMVTLYHPTHSHLGLPLPLLSSGGWLNMNTAKAFQDYAELCFRELGDLVKLWITINEPNRLSDMYNRTSNDTYRAAHNLMIAHAQVWHLYDRQYRPVQHGAVSLSLHADWAEPANPYADSHWRAAERFLQFEIAWFAEPLFKTGDYPAAMREYIASKHRRGLSSSALPRLTEAERRLLKGTVDFCALNHFTTRFVMHEQLAGSRYDSDRDIQFLQDITRLSSPTRLAVIPWGVRKLLRWVRRNYGDMDIYITASGIDDQALEDDRLRKYYLGKYLQEVLKAYLIDKVRIKGYYAFKLAEEKSKPRFGFFTSDFKAKSSIQFYNKVISSRGFPFENSSSRCSQTQENTECTVCLFLVQKKPLIFLGCCFFSTLVLLLSIAIFQRQKRRKFWKAKNLQHIPLKKGKRVVS

SEQ ID NO: 464 - protein, 1044 aa, Artificial Sequence
  Description of Artificial Sequence: Synthetic polypeptide
MKPGCAAGSPGNEWIFFSTDEITTRYRNTMSNGGLQRSVILSALILLRAVTGFSGDGRAIWSKNPNFTPVNESQLFLYDTFPKNFFWGIGTGALQVEGSWKKDGKGPSIWDHFIHTHLKNVSSTNGSSDSYIFLEKDLSALDFIGVSFYQFSISWPRLFPDGIVTVANAKGLQYYSTLLDALVLRNIEPIVTLYHWDLPLALQEKYGGWKNDTIIDIFNDYATYCFQMFGDRVKYWITIHNPYLVAWHGYGTGMHAPGEKGNLAAVYTVGHNLIKAHSKVWHNYNTHFRPHQKGWLSITLGSHWIEPNRSENTMDIFKCQQSMVSVLGWFANPIHGDGDYPEGMRKKLFSVLPIFSEAEKHEMRGTADFFAFSFGPNNFKPLNTMAKMGQNVSLNLREALNWIKLEYNNPRILIAENGWFTDSRVKTEDTTAIYMMKNFLSQVLQAIRLDEIRVFGYTAWSLLDGFEWQDAYTIRRGLFYVDFNSKQKERKPKSSAHYYKQIIRENGFSLKESTPDVQGQFPCDFSWGVTESVLKPESVASSPQFSDPHLYVWNATGNRLLHRVEGVRLKTRPAQCTDFVNIKKQLEMLARMKVTHYRFALDWASVLPTGNLSAVNRQALRYYRCVVSEGLKLGVFPMVTLYHPTHSHLGLPLPLLSSGGWLNMNTAKAFQDYAELCFRELGDLVKLWITINEPNRLSDMYNRTSNDTYRAAHNLMIAHAQVWHLYDRQYRPVQHGAVSLSLHCDWAEPANPFVDSHWKAAERFLQFEIAWFADPLFKTGDYPSVMKEYIASKNQRGLSSSVLPRFTAKESRLVKGTVDFYALNHFTTRFVIHKQLNTNRSVADRDVQFLQDITRLSSPTRLAVIPWGVRKLLRWVRRNYGDMDIYITASGIDDQALEDDRLRKYYLGKYLQEVLKAYLIDKVRIKGYYAFKLAEEKSKPRFGFFTSDFKAKSSIQFYNKVISSRGFPFENSSSRCSQTQENTECTVCLFLVQKKPLIFLGCCFFSTLVLLLSIAIFQRQKRRKFWKAKNLQHIPLKKGKRVVS

SEQ ID NO: 465 - protein, 1044 aa, Artificial Sequence
  Description of Artificial Sequence: Synthetic polypeptide
MKPGCAAGSPGNEWIFFSTDEITTRYRNTMSNGGLQRSVILSALILLRAVTGFSGDGRAIWSKNPNFTPVNESQLFLYDTFPKNFFWGIGTGALQVEGSWKKDGKGPSIWDHFIHTHLKNVSSTNGSSDSYIFLEKDLSALDFIGVSFYQFSISWPRLFPDGIVTVANAKGLQYYSTLLDALVLRNIEPIVTLYHWDLPLALQEKYGGWKNDTIIDIFNDYATYCFQMFGDRVKYWITIHNPYLVAWHGYGTGMHAPGEKGNLAAVYTVGHNLIKAHSKVWHNYNTHFRPHQKGWLSITLGSHWIEPNRSENTMDIFKCQQSMVSVLGWFANPIHGDGDYPEGMRKKLFSVLPIFSEAEKHEMRGTADFFAFSFGPNNFKPLNTMAKMGQNVSLNLREALNWIKLEYNNPRILIAENGWFTDSRVKTEDTTAIYMMKNFLSQVLQAIRLDEIRVFGYTAWSLLDGFEWQDAYTIRRGLFYVDFNSKQKERKPKSSAHYYKQIIRENGFSLKESTPDVQGQFPCDFSWGVTESVLKPESVASSPQFSDPHLYVWNATGNRLLHRVEGVRLKTRPAQCTDFVNIKKQLEMLARMKVTHYRFALDWASVLPTGNLSAVNRQALRYYRCVVSEGLKLGISAMVTLYYPTHAHLGLPEPLLHADGWLNPSTAEAFQAYAGLCFQELGDLVKLWITINEPNRLSDIYNRSGNDTYGAAHNLLVAHALAWRLYDQQFRPSQRGAVSLSLHCDWAEPANPFVDSHWKAAERFLQFEIAWFADPLFKTGDYPSVMKEYIASKNQRGLSSSVLPRFTAKESRLVKGTVDFYALNHFTTRFVIHKQLNTNRSVADRDVQFLQDITRLSSPSRLAVTPWGVRKLLAWIRRNYRDRDIYITANGIDDLALEDDQIRKYYLEKYVQEALKAYLIDKVKIKGYYAFKLTEEKSKPRFGFFTSDFRAKSSVQFYSKLISSSGFPFENSSSRCSQTQENTECTVCLFLVQKKPLIFLGCCFFSTLVLLLSIAIFQRQKRRKFWKAKNLQHIPLKKGKRVVS

SEQ ID NO: 466 - protein, 1044 aa, Artificial Sequence
  Description of Artificial Sequence: Synthetic polypeptide
MKTGCAAGSPGNEWIFFSSDERNTRSRKTMSNRALQRSAVLSAFVLLRAVTGFSGDGKAIWDKKQYVSPVNPSQLFLYDTFPKNFFWGIGTGALQVEGSWKKDGKGPSIWDHFIHTHLKNVSSTNGSSDSYIFLEKDLSALDFIGVSFYQFSISWPRLFPDGIVTVANAKGLQYYSTLLDALVLRNIEPIVTLYHWDLPLALQEKYGGWKNDTIIDIFNDYATYCFQMFGDRVKYWITIHNPYLVAWHGYGTGMHAPGEKGNLAAVYTVGHNLIKAHSKVWHNYNTHFRPHQKGWLSITLGSHWIEPNRSENTMDIFKCQQSMVSVLGWFANPIHGDGDYPEGMRKKLFSVLPIFSEAEKHEMRGTADFFAFSFGPNNFKPLNTMAKMGQNVSLNLREALNWIKLEYNNPRILIAENGWFTDSRVKTEDTTAIYMMKNFLSQVLQAIRLDEIRVFGYTAWSLLDGFEWQDAYTIRRGLFYVDFNSKQKERKPKSSAHYYKQIIRENGFSLKESTPDVQGQFPCDFSWGVTESVLKPESVASSPQFSDPHLYVWNATGNRLLHRVEGVRLKTRPAQCTDFVNIKKQLEMLARMKVTHYRFALDWASVLPTGNLSAVNRQALRYYRCVVSEGLKLGISAMVTLYYPTHAHLGLPEPLLHADGWLNPSTAEAFQAYAGLCFQELGDLVKLWITINEPNRLSDIYNRSGNDTYGAAHNLLVAHALAWRLYDQQFRPSQRGAVSLSLHADWAEPANPYADSHWRAAERFLQFEIAWFAEPLFKTGDYPAAMREYIASKHRRGLSSSALPRLTEAERRLLKGTVDFCALNHFTTRFVMHEQLAGSRYDSDRDIQFLQDITRLSSPTRLAVIPWGVRKLLRWVRRNYGDMDIYITASGIDDQALEDDRLRKYYLGKYLQEVLKAYLIDKVRIKGYYAFKLAEEKSKPRFGFFTSDFKAKSSIQFYNKVISSRGFPFENSSSRCSQTQENTECTVCLFLVQKKPLIFLGCCFFSTLVLLLSIAIFQRQKRRKFWKAKNLQHIPLKKGKRVVS

SEQ ID NO: 467 - protein, 1044 aa, Artificial Sequence
  Description of Artificial Sequence: Synthetic polypeptide
MKPGCAAGSPGNEWIFFSTDEITTRYRNTMSNGGLQRSVILSALILLRAVTGFSGDGRAIWSKNPNFTPVNESQLFLYDTFPKNFSWGVGTGAFQVEGSWKTDGRGPSIWDRYVYSHLRGVNGTDRSTDSYIFLEKDLLALDFLGVSFYQFSISWPRLFPNGTVAAVNAQGLRYYRALLDSLVLRNIEPIVTLYHWDLPLALQEKYGGWKNDTIIDIFNDYATYCFQMFGDRVKYWITIHNPYLVAWHGYGTGMHAPGEKGNLAAVYTVGHNLIKAHSKVWHNYNTHFRPHQKGWLSITLGSHWIEPNRSENTMDIFKCQQSMVSVLGWFANPIHGDGDYPEGMRKKLFSVLPIFSEAEKHEMRGTADFFAFSFGPNNFKPLNTMAKMGQNVSLNLREALNWIKLEYNNPRILIAENGWFTDSRVKTEDTTAIYMMKNFLSQVLQAIRLDEIRVFGYTAWSLLDGFEWQDAYTIRRGLFYVDFNSKQKERKPKSSAHYYKQIIRENGFSLKESTPDVQGQFPCDFSWGVTESVLKPESVASSPQFSDPHLYVWNATGNRLLHRVEGVRLKTRPAQCTDFVNIKKQLEMLARMKVTHYRFALDWASVLPTGNLSAVNRQALRYYRCVVSEGLKLGISAMVTLYYPTHAHLGLPEPLLHADGWLNPSTAEAFQAYAGLCFQELGDLVKLWITINEPNRLSDIYNRSGNDTYGAAHNLLVAHALAWRLYDQQFRPSQRGAVSLSLHADWAEPANPYADSHWRAAERFLQFEIAWFAEPLFKTGDYPAAMREYIASKHRRGLSSSALPRLTEAERRLLKGTVDFCALNHFTTRFVMHEQLAGSRYDSDRDIQFLQDITRLSSPTRLAVIPWGVRKLLRWVRRNYGDMDIYITASGIDDQALEDDRLRKYYLGKYLQEVLKAYLIDKVRIKGYYAFKLAEEKSKPRFGFFTSDFKAKSSIQFYNKVISSRGFPFENSSSRCSQTQENTECTVCLFLVQKKPLIFLGCCFFSTLVLLLSIAIFQRQKRRKFWKAKNLQHIPLKKGKRVVS

SEQ ID NO: 468 - protein, 1043 aa, Mus musculus; identical to SEQ ID NO: 360

SEQ ID NO: 469 - DNA, 3132 bp, Mus musculus
atgaagacaggctgtgcagcagggtctccggggaatgaatggattttcttcagctctgatgaaagaaacacacgctctaggaaaacaatgtccaacagggcactgcaaagatctgccgtgctgtctgcgtttgttctgctgcgagctgttaccggcttctccggagacgggaaagcaatatgggataaaaaacagtacgtgagtccggtaaacccaagtcagctgttcctctatgacactttccctaaaaacttttcctggggcgttgggaccggagcatttcaagtggaagggagttggaagacagatggaagaggaccctcgatctgggatcggtacgtctactcacacctgagaggtgtcaacggcacagacagatccactgacagttacatctttctggaaaaagacttgttggctctggattttttaggagtttctttttatcagttctcaatctcctggccacggttgtttcccaatggaacagtagcagcagtgaatgcgcaaggtctccggtactaccgtgcacttctggactcgctggtacttaggaatatcgagcccattgttaccttgtaccattgggatttgcctctgacgctccaggaagaatatgggggctggaaaaatgcaactatgatagatctcttcaacgactatgccacatactgcttccagacctttggagaccgtgtcaaatattggattacaattcacaacccttaccttgttgcttggcatgggtttggcacaggtatgcatgcaccaggagagaagggaaatttaacagctgtctacactgtgggacacaacctgatcaaggcacattcgaaagtgtggcataactacgacaaaaacttccgccctcatcagaagggttggctctccatcaccttggggtcccattggatagagccaaacagaacagacaacatggaggacgtgatcaactgccagcactccatgtcctctgtgcttggatggttcgccaaccccatccacggggacggcgactaccctgagttcatgaagacgggcgccatgatccccgagttctctgaggcagagaaggaggaggtgaggggcacggctgatttctttgccttttccttcgggcccaacaacttcaggccctcaaacaccgtggtgaaaatgggacaaaatgtatcactcaacttaaggcaggtgctgaactggattaaactggaatacgatgaccctcaaatcttgatttcggagaacggctggttcacagatagctatataaagacagaggacaccacggccatctacatgatgaagaatttcctaaaccaggttcttcaagcaataaaatttgatgaaatccgcgtgtttggttatacggcctggactctcctggatggctttgagtggcaggatgcctatacgacccgacgagggctgttttatgtggactttaacagtgagcagaaagagaggaaacccaagtcctcggctcattactacaagcagatcatacaagacaacggcttccctttgaaagagtccacgccagacatgaagggtcggttcccctgtgatttctcttggggagtcactgagtctgttcttaagcccgagtttacggtctcctccccgcagtttaccgatcctcacctgtatgtgtggaatgtcactggcaacagattgctctaccgagtggaaggggtaaggctgaaaacaagaccatcccagtgcacagattatgtgagcatcaaaaaacgagttgaaatgttggcaaaaatgaaagtcacccactaccagtttgctctggactggacctctatccttcccactggcaatctgtccaaagttaacagacaagtgttaaggtactataggtgtgtggtgagcgaaggactgaagctgggcgtcttccccatggtgacgttgtaccacccaacccactcccatctcggcctccccctgccacttctgagcagtggggggtggctaaacatgaacacagccaaggccttccaggactacgctgagctgtgcttccgggagttgggggacttggtgaagctctggatcaccatcaatgagcctaacaggctgagtgacatgtacaaccgcacgagtaatgacacctaccgtgcagcccacaacctgatgatcgcccatgcccaggtctggcacctctatgataggcagtataggccggtccagcatggggctgtgtcgctgtccttacattgcgactgggcagaacctgccaacccctttgtggattcacactggaaggcagccgagcgcttcctccagtttgagatcgcctggtttgcagatccgctcttcaagactggcgactatccatcggttatgaaggaatacatcgcctccaagaaccagcgagggctgtctagctcagtcctgccgcgcttcaccgcgaaggagagcaggctggtgaagggtaccgtcgacttctacgcactgaaccacttcactacgaggttcgtgatacacaagcagctgaacaccaaccgctcagttgcagacagggacgtccagttcctgcaggacatcacccgcctaagctcgcccagccgcctggctgtaacaccctggggagtgcgcaagctccttgcgtggatccggaggaactacagagacagggatatctacatcacagccaatggcatcgatgacctggctctagaggatgatcagatccgaaagtactacttggagaagtatgtccaggaggctctgaaagcatatctcattgacaaggtcaaaatcaaaggctactatgcattcaaactgactgaagagaaatctaagcctagatttggatttttcacctctgacttcagagctaagtcctctgtccagttttacagcaagctgatcagcagcagtggcctccccgctgagaacagaagtcctgcgtgtggtcagcctgcggaagacacagactgcaccatttgctcatttctcgtggagaagaaaccactcatcttcttcggttgctgcttcatctccactctggctgtactgctatccatcaccgtttttcatcatcaaaagagaagaaaattccagaaagcaaggaacttacaaaatataccattgaagaaaggccacagcagagttttcagctaa

SEQ ID NO: 470 - protein, 439 aa, Mus musculus
PKNFSWGVGTGAFQVEGSWKTDGRGPSIWDRYVYSHLRGVNGTDRSTDSYIFLEKDLLALDFLGVSFYQFSISWPRLFPNGTVAAVNAQGLRYYRALLDSLVLRNIEPIVTLYHWDLPLTLQEEYGGWKNATMIDLFNDYATYCFQTFGDRVKYWITIHNPYLVAWHGFGTGMHAPGEKGNLTAVYTVGHNLIKAHSKVWHNYDKNFRPHQKGWLSITLGSHWIEPNRTDNMEDVINCQHSMSSVLGWFANPIHGDGDYPEFMKTGAMIPEFSEAEKEEVRGTADFFAFSFGPNNFRPSNTVVKMGQNVSLNLRQVLNWIKLEYDDPQILISENGWFTDSYIKTEDTTAIYMMKNFLNQVLQAIKFDEIRVFGYTAWTLLDGFEWQDAYTTRRGLFYVDFNSEQKERKPKSSAHYYKQIIQDNGFPLKESTPDMKGRFP

SEQ ID NO: 471 - protein, 538 aa, Mus musculus
FPLKESTPDMKGRFPCDFSWGVTESVLKPEFTVSSPQFTDPHLYVWNVTGNRLLYRVEGVRLKTRPSQCTDYVSIKKRVEMLAKMKVTHYQFALDWTSILPTGNLSKVNRQVLRYYRCVVSEGLKLGVFPMVTLYHPTHSHLGLPLPLLSSGGWLNMNTAKAFQDYAELCFRELGDLVKLWITINEPNRLSDMYNRTSNDTYRAAHNLMIAHAQVWHLYDRQYRPVQHGAVSLSLHCDWAEPANPFVDSHWKAAERFLQFEIAWFADPLFKTGDYPSVMKEYIASKNQRGLSSSVLPRFTAKESRLVKGTVDFYALNHFTTRFVIHKQLNTNRSVADRDVQFLQDITRLSSPSRLAVTPWGVRKLLAWIRRNYRDRDIYITANGIDDLALEDDQIRKYYLEKYVQEALKAYLIDKVKIKGYYAFKLTEEKSKPRFGFFTSDFRAKSSVQFYSKLISSSGLPAENRSPACGQPAEDTDCTICSFLVEKKPLIFFGCCFISTLAVLLSITVFHHQKRRKFQKARNLQNIPLKKGHSRVFS

SEQ ID NO: 472 - protein, 193 aa, Mus musculus
MKTGCAAGSPGNEWIFFSSDERNTRSRKTMSNRALQRSAVLSAFVLLRAVTGFSGDGKAIWDKKQYVSPVNPSQLFLYDTFPKNFSWGVGTGAFQVEGSWKTDGRGPSIWDRYVYSHLRGVNGTDRSTDSYIFLEKDLLALDFLGVSFYQFSISWPRLFPNGTVAAVNAQGLRYYRALLDSLVLRNIEPIVTL

SEQ ID NO: 473 - protein, 221 aa, Mus musculus
PKNFSWGVGTGAFQVEGSWKTDGRGPSIWDRYVYSHLRGVNGTDRSTDSYIFLEKDLLALDFLGVSFYQFSISWPRLFPNGTVAAVNAQGLRYYRALLDSLVLRNIEPIVTLYHWDLPLTLQEEYGGWKNATMIDLFNDYATYCFQTFGDRVKYWITIHNPYLVAWHGFGTGMHAPGEKGNLTAVYTVGHNLIKAHSKVWHNYDKNFRPHQKGWLSITLGS

SEQ ID NO: 474 - protein, 223 aa, Mus musculus
YHWDLPLTLQEEYGGWKNATMIDLFNDYATYCFQTFGDRVKYWITIHNPYLVAWHGFGTGMHAPGEKGNLTAVYTVGHNLIKAHSKVWHNYDKNFRPHQKGWLSITLGSHWIEPNRTDNMEDVINCQHSMSSVLGWFANPIHGDGDYPEFMKTGAMIPEFSEAEKEEVRGTADFFAFSFGPNNFRPSNTVVKMGQNVSLNLRQVLNWIKLEYDDPQILISENG

SEQ ID NO: 475 - protein, 205 aa, Mus musculus
SHWIEPNRTDNMEDVINCQHSMSSVLGWFANPIHGDGDYPEFMKTGAMIPEFSEAEKEEVRGTADFFAFSFGPNNFRPSNTVVKMGQNVSLNLRQVLNWIKLEYDDPQILISENGWFTDSYIKTEDTTAIYMMKNFLNQVLQAIKFDEIRVFGYTAWTLLDGFEWQDAYTTRRGLFYVDFNSEQKERKPKSSAHYYKQIIQDNGF

SEQ ID NO: 476 - protein, 104 aa, Mus musculus
GWFTDSYIKTEDTTAIYMMKNFLNQVLQAIKFDEIRVFGYTAWTLLDGFEWQDAYTTRRGLFYVDFNSEQKERKPKSSAHYYKQIIQDNGFPLKESTPDMKGRF

SEQ ID NO: 477 - protein, 126 aa, Mus musculus
PLKESTPDMKGRFPCDFSWGVTESVLKPEFTVSSPQFTDPHLYVWNVTGNRLLYRVEGVRLKTRPSQCTDYVSIKKRVEMLAKMKVTHYQFALDWTSILPTGNLSKVNRQVLRYYRCVVSEGLKLG

SEQ ID NO: 478 - protein, 216 aa, Mus musculus
PCDFSWGVTESVLKPEFTVSSPQFTDPHLYVWNVTGNRLLYRVEGVRLKTRPSQCTDYVSIKKRVEMLAKMKVTHYQFALDWTSILPTGNLSKVNRQVLRYYRCVVSEGLKLGVFPMVTLYHPTHSHLGLPLPLLSSGGWLNMNTAKAFQDYAELCFRELGDLVKLWITINEPNRLSDMYNRTSNDTYRAAHNLMIAHAQVWHLYDRQYRPVQHGA

SEQ ID NO: 479 - protein, 218 aa, Mus musculus
GVFPMVTLYHPTHSHLGLPLPLLSSGGWLNMNTAKAFQDYAELCFRELGDLVKLWITINEPNRLSDMYNRTSNDTYRAAHNLMIAHAQVWHLYDRQYRPVQHGAVSLSLHCDWAEPANPFVDSHWKAAERFLQFEIAWFADPLFKTGDYPSVMKEYIASKNQRGLSSSVLPRFTAKESRLVKGTVDFYALNHFTTRFVIHKQLNTNRSVADRDVQFLQ

SEQ ID NO: 480 - protein, 229 aa, Mus musculus
AVSLSLHCDWAEPANPFVDSHWKAAERFLQFEIAWFADPLFKTGDYPSVMKEYIASKNQRGLSSSVLPRFTAKESRLVKGTVDFYALNHFTTRFVIHKQLNTNRSVADRDVQFLQDITRLSSPSRLAVTPWGVRKLLAWIRRNYRDRDIYITANGIDDLALEDDQIRKYYLEKYVQEALKAYLIDKVKIKGYYAFKLTEEKSKPRFGFFTSDFRAKSSVQFYSKLISSS

SEQ ID NO: 481 - protein, 81 aa, Mus musculus
MKTGCAAGSPGNEWIFFSSDERNTRSRKTMSNRALQRSAVLSAFVLLRAVTGFSGDGKAIWDKKQYVSPVNPSQLFLYDTF

SEQ ID NO: 482 - protein, 112 aa, Mus musculus
PKNFSWGVGTGAFQVEGSWKTDGRGPSIWDRYVYSHLRGVNGTDRSTDSYIFLEKDLLALDFLGVSFYQFSISWPRLFPNGTVAAVNAQGLRYYRALLDSLVLRNIEPIVTL

SEQ ID NO: 483 - protein, 19 aa, Artificial Sequence
  Description of Artificial Sequence: Synthetic peptide
  MOD_RES (6)..(6): Thr or absent
RIKSKXDGGTTDYAAPVKG

What is claimed is:

1. An isolated monoclohal antibody that specifically binds to human B-Klotho polypeptide comprising SEQ ID NO: 7, wherein said antibody comprises heavy chain variable region comprising complementarity determining regions (CDRs) comprising the amino acid sequences of SEQ ID NO: 122, SEQ ID NO: 133, and SEQ ID NO: 148 and a light chain variable region comprising CDRs comprising the amino acid sequences of SEQ ID NO: 166, SEQ ID NO: 176, SEQ ID NO: 188.

2. The antigen binding protein of claim 1, wherein the antigen binding protein is a human antibody, a humanized antibody, chimeric antibody, a monoclonal antibody, a polyclonal antibody, a recombinant antibody, an antigen-binding antibody fragment, a single chain antibody, a diabody, a triabody, a tetrabody, a Fab fragment, an F(fab')$_2$ fragment, a domain antibody, an IgD antibody, an IgE antibody, an IgM antibody, an IgG1 antibody, an IgG2 antibody, an IgG3 antibody, an IgG4 antibody, or an IgG4 antibody having at least one mutation in the hinge region.

3. A pharmaceutical composition comprising the isolated monoclonal antibody of claim 1 and a pharmaceutically acceptable carrier.

* * * * *